United States Patent 10,724,096 (METHODS AND COMPOSITIONS FOR INHIBITING AND TREATING NEUROLOGICAL CONDITIONS) - sequence listing, part 117

SEQ ID NO: 2104 - DNA, 129507 bp, Homo sapiens
atatcaagttgtcaatgtaatttatataacttttatttttatataatttcacatgtacagaaaaatacccatatacctttacccaaatagctaccaccaagaaatctctgttgtaacatttcaatcgccattccctctgaaataataacaaagcactttatttgagtattccgtattccccaaagctagctgtgaaagacctacatcacctcaaaaccttccatttggttccatagatcctgccatgtcacattcttgtaaccagctgcagggccatcttgttataactggttcatgtcctgctaaagctgagaggtgaagggctaaaaacacagtcctggcacagattccaggacaccccggcacaggcttgtttgaggacattgcctgggtaaacagcctcccctgaaagtgttcagtgtacaactcttcacagagcaatcgctcaaatgcgtggcagcacgcagacatgtctctcggcttctctccttgtctctgttgccttcctctccagtcggtgctttagaaatgctttattcccattgtccactgaaaatacaacctagattccttcagtaaatatctgttaaggaggtcacatgaaaagattgctccaactcattcttgctggtgggctcccaagggtaaaataatatagttcgtgtcttctcagtcatgaggaaaccattgtcactaaatctccctgggatgcttcctacatccaaccaaacaaagggagcgacagctgaggtctccaggtcaaaaacaaatatgtcaccttgctgagagatgatggcctgaaaaagaaaaaaaaaaatgaatgaagtgaaggatgagggaagagttatatagtctgtatacagttcctgtaaacatttatgtgggcttaacaaggagtccacttcccacaactttggttctacaactgctaaagtgcagtttcaaacacaaaacaatacatggaaaatgactacaggctatggaacgttaccaaattataatcacaaatcaaggaaatacatcgtctccaatcattaaggagaatatttcacaagaagctcaaagctttacatcttttacagtttttctcagagtatcatcaagagagcaacatttttacatacagcctgggtggttttaatgactttctaaggatatatctggacctagctacagagcccaactgtggagcttacattcaagtctcctgaaaagatccagcaatctagaaagtccactgccagaaatttacaaaagctctaccattagagcttatctcttttactgcatagttaagtaaagtcacattattagcattttttttacatgtgtgaattccacaaaatagcagcaaaaagagacagtgcaatttaaatcgtgttggctccattcctcttaagtagccgaatagcatatgcccagagtgaggatgcgctgctccccagagtgggagggtttgcaaacctctctttgtgtgagcacggagctgagtgcaacctggtttcttaatctgtgcatttgtcatgcaacatctcagtcttacattatatgttatgtgtgacataaagaatttcaaagggccattttcactatatataatttagccttacatatttgtgtaatatgttatcattcagggttctgagttatacacaaggaaacctatattgatagaagcagaaaagaagcttaataaagcgtatcaggttgctcttcaggatcagagactcaggcttgaatttggatggcaaattcccagatcgcaccgcccagctgttccagtgaaggtcctaaagcagccacaggaacaaggttcatgcggctcatgccagcctgcccaggaagctgccagggtagcatcagcttctgctgctccaagaccaaggccgaaagagatgctggtgtcatgcttatgctggttatcttcgttggattggaaatctcctctctgtatgtctgactgcagagcctgggattcaagcttgcaccctggcttcagggagacagggagaacaagtttctggcatctcccttgagaaaagaagccaaatacctagtctatattagccccgaattaaacattaactaacagtattattactatcattttatctctttaagaaggacaagtctcactgaaatcaaaatgagatagaacaaagaaagagccctgcttttctcccaccccaattacccacctcaaggtaatgaaggcctaactcaggaaagaaaaaaatttggttttcaaaatcataagtttagagactgaaaattcatccagtacatagtggttttttttttcttttttggaaaaaaatatatgtaagactgtcattttcttctgttctctattagttgttacagataacttggattttattatgtgactatagaaagaaggtatgttttcagttgttaggctctttcaaataaaacacaagaattaggtgtttttatatgattatttctaaattaaatgtagaaaatccctttctatgaagtaaaagtgtaaaacaaatttaaaattttctaaaaacagagaatgtaactttctagaaagatatttcctgagtgtccagaagataagataataaaattaaaaacatatatgtgtacatatatttccaactgctatgtgtaggggagaaggaaggaaaggttttcaacctactagacaaattccaaattctccagctgcacaatttttataacaacacatcctgatcatcccatttttatatcttggcaattataaaaagatttggtgattgagctactttgaagcaataaatcaaagagactagagtgaatattaatagactctacttaaaattagactgcgtcagctgggctccaatgcttcccagctacaggacctcgagctcatcacttaacctcctaaactggcttccaaacttacaaaatgcagatgataatgcctggagctgtggtgaaagtcagagactatgaggtgaagcacctagaacacagcctggaacctagtgggcatgcaggcagtggtgatgactcgagcttcctctcccatcactgcacctgcccactaaggaggggtgatgggacaaacgagtagtggtcaccagcaactctgacaaatcctggattcgaaatagaaatcatttggtgtttgcttttagtgggaagaggccaatcttcccccaggcctcaggtaaactcagcaccaagggggacacatgcaaatctcaggatgcaaggagctggcccaagagcaggagaaccccacaaggccacagtcccctgccctccgccatgacctgtgcttacagtgatctgcgccttgcagagccccacggcctccttcggtgaggacaagaagtggtagttggtcgggctcaggagttcatggtcagctgaaaggtaaaaggaaaccacacagctttcccgtgtgcaattcccacatctcctcagcaattcagacactggctcctcataaaggcagacagcctctcctcctttcatcacaaaacgttcagtcacacgagagcacacgggctccagggagctccatgtatggactctcacctggggagaaataaaacagaataaaaacaggcattcttggttgctatgtttttaaggaacaatagtagtaataattgctgaaagtcaggttagcagaaatggttaagagactatgaaacctgagttttaatcccagtcctgcaaaatactagctatgtgactaagtaacttctcagtcttcatttcttcatatgtagaatgaaaataacagcagtaatgtcacaggctgttgtgagaatttaaaaaataatccacggaaggcacagtacctggtgcgttgtaatttttctgtaaatgtgacctattttcagtgttattagtgtcctccaaactatagccacctaagactttgagtttctagcctttctttttacttaaatttgttttttaaaacaaatttgctttccacatgcgcattctgaatagttttactgattttcactataacatgccatttttaaccatttctttttataaagtttggactatttccagcctctcacaattataaataaccttgcatttaaggggcacattatagcatatgtgatttgctttcatctagttattttatttcctactcatagaaatcctgtaagaagagagactggtatcattttactgagaagaaattgaatcaacaagatgtgaagggttttgcttatggtcacatgattaatggcagggttgtagcctgaatatatgtattctaactctaaattaatttctcttttattttcccaaaagaatgtaaccaaacaactaaagaaatcatctaaaagtctccttcgatcttagaaaacaatccaagtaacttacactgagtgtcatcgaataatccgagtgaagatctgacacaccatagatatagaacgtgttttcattctcaaagcctactggcaacagtggagcaaagaaattctgagcaaagtaatgaagcattttccactttcctccgtactctgaaaataatcaagagtgtcaggagacggcaaggtcaagtagtcagagaggcactgtccaatggcccagctgtttgtggctcatcggggttctaagggagtgagcatgtgagggagagtcaacagtggagggcacccatgtttgtgaagcgctctgagcactctggacattatgtcatgtcaccctcacaacatctgggcaggcactaacgaaccagggcaggcattaacgaaccatgctgttaggcaatttcatcattgtgtgatcatagagtgtacttaaacaaaccaagatggtatagcctactacacacctagactatatggtatagcctgttgctccaggctactaacctgtacagcatattgctgtgctgaatactgtaggtaattctaatcatagaaatgggacagtgaaaatacagtattataatctcatgggaccaccatcatatatgaactgtgttgttgactgaaatgttatacggtgcatgactgtatataataacttatagattctaggtagctattgattgctttaatatataaccatttcgggtgataagagataacaaatacctcccctactgcacgcactagaagcagtggatttattgagccaatcaacatggggctgtgaggcccccagagcagaagcagatatagaaaacttgtcacagcttctcccggataacctttttgtctaataagtacaaggagctggtgatcctcctcaggcaggcaggatcctgccagggtttagaaaacagccaagctctggtacttgggttttcctactgtaatattattatatatacatatataatttttcttctacagttagatatggtttggctgtgcccctacccaaatctcatcttgaattgtagctcccacaattcccatgtgttgtaggagggacctggtaggaggtaactgaaccatgggggcaggtctttcctatgctgttcttgtgatagtgaataagtctcacgagatctgatcgttttataaagaaggagtttcctgcacaagtcctctcttacccactgccatgtaagaagtccctttgctcttccttcgtcttctgccatgattgtgaggtcttcccagccatgtggaactgtgagtccattaaacctctttttctttacaaattaccagtctcaggtatgtcttcatcagcagcatgagaacagactaatacaggttcctagctcacaactaccatagcccttgttacagactcttgttataatgttgagaagctttaggactcaaaagcaggcctcagaaaacagaatctatctctctgatctccttccctcctttcaccagcccaaggcaggtctctaatccgattgtgggtcataagacactcattcagaaggtgtcctgcctcataccctggaggaggaaatgcttcacagagaggccaagaagctgaatggacaggccttgctgtgtttccccactcagtctaatggtattagatcatacccgctttgtccaatcacatttctacatggttatcaatcatggctgtccaatgaagtctccctataacgcccaagaggacagagttcaaagaacttccacatagctgaccatgtgaaggctgacagaaagaggaacaagtattcatctacatgcctggagggtggcacaccccagcctcacagggataaagttcctgcactcaggacccttccagacttcaccccatatatctcttcatacggctgtttatttgtgtcttttaaaacatcctctgtaatacagcagttagaatgtttccttgagttctgtgagccattccagcaaattaaacccaaagaaggggtcatgggaaccccagcttgaagctggtcagtcagaagttctagaggcccagacttgcgactgctgtctaaagagggaaggcagctttgtggaactgagttctcaacctatggaatctgatgcaatctgcaggtagatagtgtcagacttaaattggagggcactcgcatggtgtccactgcagaagtgattgcttgcttggtgtgtgggggaagtttcccatatatttggtcacagaagtcttctgtgtggattgttgttgtggagtgagggaattaacaaagcacttttaggccaggtgcggtggctcatgcctgtaatcccaacactttgggaagctgaggagggtagactgcttcagaccaggtgttcaagaccagcctgggcaacatggcaaaaccctgtctccagaaaaaaaatacaaaaatgagccaggcatggtggtatgcagctatagacccaggtactcaggaagttgaggtgggaggaaggcttgagcctgtggggtggaggctacagtgagccatgattgcaccactgcactccagcctgggcaaaagcagagtgagaccatctcaacaaaaaaacaaaacaaaacaaaaaaccacttagagtttgagtgtcttgtttcccacagacctactcttcctgaggaactcaggaataatctgcatgggatcacttaaaggaatatttacaaaaattgggctctcccatttcttgaatcgaactcagtttcagtccacaacctcatccacagacagaaagcaggatcagtatccaagagtctctgaacagttatctctttgcctacctttccagcatcccagaaggattttccccccaattctacccctgattctcattcaatgctctcttatctggttggtgctgataaagagtttggtcagagaaatttgattagaaatccaattctctgtaagagtcatccatctggcactaatgaaaacatgtttggaatgaatttcttttgatctgcattcacagccagtttaagagcctcacccctgcactctagcctgggtgtcagaacaagactctgtctcaaaaaaaacaaaaagaacctcacccaacctttctactttgtggccttgcctcgtttttgaccccaaactattctttacattattaactgaactttgtttcaagtcatctctagtgaagggcaaagactattattccttaattttttttaatgtaccagaatagatgggataattcgaactgcaggttccatgccagtcatctcacctgttgctagttgaactgtttcaactggtcacctttcccattcgggattctgcctctactagcttttccccaagagctaaacagggcataataaagatggccttaagagacatcttcattatgtccttaaaggacatctttatttgtccttaaaggtgaatcagagaaagggaaactttaacacataagcgggccaaacttctacctgattgaattctccaacacagaagaagggatgcttaagttcatgcttctttagccctggaatgccctcttaaataaattcaaaattctatgcgtaataacaagacacatggctgagacttttgtataggaatctatcccatgcttagcctgctgttgcaactttgcacagcacagaacccataattaggttgaccctaaggctcatggaaaggctactaaggtgagttgggtggctgtagttcctaggcaggctttttaaagaatgactcttttggtcatagttctgcctgggctaatctgacccctccagcactgtgctttctcagtccctctccccacagtgttgctttctctcactcgcacaaagaacgctgaaatgcttaccaagagaagcccaggaaggagcttgccagatgtcattcaactgccaataaagtgcccccatcgtgtgcccttgctgatccactatctcgctgcgactacggcggtagaattcagtttctgttttgacacactgggcctgcatcacctgattcaggaaaacattcatacacaggtgttattgtttgatgtagactgcctagatctgagaaaaatacagggtttagttttgttttgggttttttctttttggagcaatttggataaaattagggaatttaattagtattaggaatacattatactagatctgtaactagccccttagcatgagagaagctgttgtctgtaacagtgggtttgtctggtagacttggtgtttcattatggtgacaatggaaataggatggtgtaaaaggttctctgctaatgatagtgtaggccgtaaagaaaaacaaagactactattccagagcaaatgctatatatagtccaaaactagattattttcactgaaaaattttgctaataccttcatagctatttttaagaaaaacttttactagaaaaaattctataagaaaaataacattgttattatgagtctgatattatccaatccctaattattttttctagtcaaacaattgttttgatgtcatgatttttggtaatgtaagatttctcatgaatgcaattccttcgttgtagcagaacagatggcaaattgcagcaatgagacaaatgaatttagttcttgtttaagagacactaaagaacttcacacaggacccttgattaccgacaccatcatggaaaaatcagtctcttttatcgctgccgttaccgacacatatgaatcacatgctcttagcctggagttgtgctgaggaggggctcatgaatggaccactgaggagaacccagagatggtcagagcagcgaggatttcagagaacaagaaggccttagaatagggctggggttttcacagaggaataaaaagaatggtgcatatggccaccaaaagactaagtcgagacgctttcccataaaagcaaaaaagctcagataaaggtagaacctttaaatagaggaaggctgaccagtaaggaagtcatagatgaggttatgacttacatgagtcacagccatcaaattccagaacggaagccagaagaaattgtggtcagtcaataaatatttaataagaacctgcaggatatgttacatactgagaatggtgggcacccctgccagaaaaaaatgatacagcccaccatatggagcttatcagcttgtgtagaagacagtccttcatcaaagaatcacagaaagatacgtaatcattaaacagtaccaatgctaagtagaagaggtatgcaatgttacaagctcatatggtggggcaattgggcagagctgtagagtgaggattggcctaaaagaagaggaatgggaaaaagagagagggcagaaccttccagagaggacaatacaccattggaggaggatgccaggtcagctaagaactgaaggaaggccaagaaggcctgagcacaggaagccgggagcaatggaagagaagctggtgagaattgcaggggccagaccctggaaggccacatgttgaaggtgttggtgtgcatcctaaaggcaaatggaggtcacaaaaggcttttgaactaaagggtgatgtgagcagatttacatttccaaaagatgactgagactactgaaggaggaagggcttgcaagggggctagagtggatttaggtagaccatttaggcaagagatggttttagctatgagcagacaaagcaatgtcttctcattcaggaaccagaccactaggaccacagcaacagtagctggaaaaaatgttctaaagcaagaatctcacaaagcaagcagcattggtgccacctcaaaatgaccatggcccctataaacatttgagttttcagtctctaaactatatcaattttcagcattatctgcaagatatatttatttctatatatccattctaacattaatctcctcactataagttattttttcctggtttaataggtaaaacttattagttccttagaattttcaaaatttgaaaaaattttaaatgcaagtaggattcctaaccctcactagcaatgaaaagaaaagagcacaaagtggctctatctagtagcctctcttacaggaaattagcatgaaagagcataaccaagactcttttgtgctccaggctctggcacagtgcagtacactccacacacagatggtaccatgctaataacatggacctgaatctatccaaaccagtgggtaccagtcaaggctaatgaatgacacctttgttcataaaaatgcagaaggctattgcccactaaacttcttaaaggggtgttgtacaatcctagttccctggaaaatctctagaacttccccttcccctttaaaaactgtacctatatttacacatccatgcatcctttcctaaaaagggcaatctttacacataagagggataaatgcttagtcattttctaggttatccagtccactgttagcagacaaatgaattttagttttaaaaatatgcctatttggctgggcgcgatagctcatgcctgtaatcccagcactttgggaggctggggtgggtgaatcacgaggtcaggagatggagatcatcctggctaacacggtgaaaccccgtctctactaaaaatacaaaaaattaaccggacgtggtggcacatgcctgtagtcccagctactcgggaagctgaggcaggagaatggcttgaacttgggaggcagaggttgcagtgagccgagatcaagccactgcactccagcctggacaacagagcgagactctgtctaaaaaagaagaaaagaaaaaaatgcctattctcagcagcttgcttgattacacttatgaaatgagtctcctatgagagacagatggtatggtgagaagaaattggatcaagatacgaagacctaagttccagttccagcactgccactggtggttgctagctgtcttccaaaaccaatatccctttcctccagagtgatggagttgtagctggactacattttccagaaacacaccccaacccctgggactttgagtagccatgtgactaagttccctcaatatctatatactttatttactaaaattatcccgacactaagaatcttccaacaaagctgttttaaaaccaagatataattcacataccataaaattcatcattttagaggttataattcattggtttttagcacagtcataaggttgcacaactctttccactatctaattccagaatattttcatcaccccaaaaagaaacaccatactgggaagcagtcactccccatcctcccctctccccggcttctggaaaccacttaatctacttcctctgttctgggatttgcctattccggacatttcacataaatggaatgataaaatatgtggcttctgtgactggcttcctttttatttctgaataatattttattgtatggagatgctacattttgcttgtctattcgtcagctgaaaaattaggttatttcccctttttggctactatgaacaatgctgctatgaatctgtgaacaggtttttgcatgaacatatgctttcaattttcttgagtatatatacctaagagtaaaattgctgggtcatatggcaaactctatgtctaactttttaaggaattaacaaactgtttaccgcagcagctgaactgttttacattcccaccagcaacatatgagggttccaatttctccacatccttgccaatactcattattttccttttttaaaaatttgtagatattgtagtggatataactggtatctcactgtggttttgatttgcatttctctaataactaatgatgttgagcatctttctatgtgtttactggtcattttctttaaagaagtgtttattcaaagcctttaccaatttttcaattgggttgtctttttcactattgagttctaagagttctttatatattctggatgctggatccctatcagacatatggtttgtaaattttttctttcattctggggattatcttttcattttctcgatagcgtcttttgccatacaaaaggtatttttgttttctgtttttgatgacatacaatttgcctattttttctttggttaatttctttgatggcaaatttaagaaactgttgcctaaccaaaagccataaaatttatacctatgtttccttctaagagttttatagttttagctattacatatagatctttgatccattttgagttaatttttgtatatggtatgaggtagtggtctgaatttattcttttgcatgtggatatccaattgttccagcaccacttgttgaaaacatgattcttcctcccattttattctttttaccatttggaatgtaaattagtacagccattatgcaaaacagtatggaggcttcccaaactattaaaaatagaactactatatgatccagcagtcccactactgtgtatctatccaaaggaaatgaaatcagtatgttgaagagatatccacactcccatgttcattacagcattatttacaatagccaagatatgaaatcaacagatgagtacataaagaaaatgtgatacatatacacaatagaatacgatccagccttaaaaataaaggaaatcctgtcagttgtgacaacctggaagaaactggaggacatcatgttaagtgaaataagtcatgcacagacaaacaaatactacatgatctcacgtatacatggaattgaaaaaagttaaactcatagaagcacagagtagaatggtgggctggatgggggaaagaggaagtaccaaggagatgctggtcaatgaatacaaaatttcaattaggagaaataagttcaagagatctattgtaaaacatggtaactataattaataatgtattgtatatttgaaaattgctaacagggtagattttaagtgttctcactacaaaaaagataagtacgtgaagcaatgcatatgtttaacagcttgaattagccattccataatgtacacatataccaaaacatcatgttgtacaccacaaatatatatttttaatttatcaattaaaataaagaaatattaatttttttaaaaaaagaaaatcagttgaccataaatgtatatttgttcctggattctcaattttattgaatcaatctattatatataccttgtcttttgtcattaccacactgtcctgattactacagctttgaagtaagttttaaaatctttttttcaacagtataagatttgtcaaatgctttttcttcatttattgagatgatcatgtgtattttttctttctttactaatatggtttattatactgattaactttcatatatcgaatcaatcttgcattcctgggatatttcccacatagttatgctatataatcctttgtatatgctgctggatttggattgataccattttattgaggatttttttctgtctacattcacaaatgatatgagtctgtaggttgcttttcatgagatatgtttgtctggttttggtatcacagtaatgttggcttcacagaatgagttaagtgtttcctcctcttattactaattttttagggagttaatgaggggtttcttttaattcttctttaaacattcttagaattcactagtgaagccatctggtcctggatttttctttttacgggaaggtttttttgtttgtttttgttttttaactaactcaatctccttagttgttatagggctattaagattttctatttcttcttaattcagttttcatgggttgtttctctaggaattcatccatttcatctaaattaactgacttgttgccatataattgtgtatatattctcttatcaccttatttattttggtaaggtgagtagtaatatttcctctttcattcctgacttagtaattcaagtgtcctctcttttttctgggccagtctaactaaaggtttgtcaattttgttgatctattcaaagaactaacttttggcttcactggttttctccagtgttctaatgaggtctttatttaatgtgccaaatttctgatgcccactttacttaattgctgaaaattactgttaacaatttaaccaaacaccattattgcaactgtgaagggatagaatattacagtttaaaaagcagaaaccctactccattcattgccctgagtccttaggcaaaatatttaacttttctgagactctgtttcctcatgtatgaaatggaaagagtgatatgggtgtctggagataatgtgagaattaaatgataagatttacaaagcagttcatgacccaggaccaggcaggcatttagtagatacccaaagaatgctacatattggcttgattattaaattacatgatgcctatacaaactcctaatatataatacacaatgttaatggtcactctttcattcccctcctttgcccaccctactctcatcttaaaagctcagtatgacctggatcttccatcgtgtctcagtgctacttaccaaacaaataaccattccagggcagcaggtatcatcaaaacctgggcctacagcatcacctaccttttgtcctagttcttatgatcaagttacttacagcacaggaagataaaatgggcctctaaagaaaatgagtttctcaagaacatccccaagccatcattagatattcaatagacacatgaagaataaacaaaagcactagaaaaggctgtaagctaagggcttggtaattaatgtccttggcctggcctgctctcttagtggccaataagaggccgtgctggtagagtaagacactcaaaagttagtttagatatgttcatttagatagttggtcctcaaactagagagtgagatctgtgtaacatagctaaagagggtgtgctcatgtatatgggctattgggaatacaatataacagggcaagagggagagtaaaaggtaaggcaagattatcctggaatactaggagaattaaagaggcaggagcccatagggatatctttttggctataagacaaagagaagatagggaaggatccaaacgtgaagaaatttactggacagttttctcagcgaagactttgctaacagttgcaaatattccttaattaataaatcttctaaaaagtggcacataggcaagcactctgttcttcagaacagtatgacagactatgagaaaaagaacaggggttggagtaggaacatagaaagtggaacagagaagggttttatttctaatacacagattaaagaggactgttctaaaatcaaagtaacaaggaaaaaccctaaaaccctaacatttcctgtctgtatttcagtcaagaaaatctgacactgaaaacaaaataaaataatcataatcctgatttctttcatcacagatagcatctagtatgttggaaagtgccaaggtagacactaacaagccacacgaggacaagtccaattctgagccaaagcctgagaggacactagtgctaaattctcagacaaaaccatcaccaacaaaaactggcaacaaataactccacttgcatgcccagttcctaactatggaccttgaatgctgataagttcagaaaagaaaaattatttctatcagttcttggaatataattttgaggaaaagaataaagttagagtaataaacagctggaaggaggaaatccagcataaaaaacaatagcagaaaagtctcttatacacacacacacacaaataataatcagcctattttatatgtcagaacactttaacagagtattatctgtggaaaacttgaaagataaagtgcaacacttttcaagggacagataccaacattgcctttaaccttgtgttctggtaagttcatgaattacatataaccctggcaaaactttcctaacctataagattatgattgaaacattaaaattctcctaatcatttcatcaccttctaaaaaagattattctttcagcttacagttttctgctttagtttctatcatggggtttgtgttttcatacaggagaaaactgatgaaggtgtgagcatgagtttggattaaaattcatacatttttagatactaagataggaaaatttaactgtgattatgtttttaaaaatttcctgtctacttcagatcaactttattattgggattaggcttttacctcctctctaagaactttaaacaagtatggcaaaactagcaggtaaataaacagcgactttaatggagtcttaagtgtggtcacaggttcatgaactaaaataggcaaatgaaaaaagtaaaatgaaaccattatccaaaattcagtttggcagtttcttaaaaaaaatacataaatttgttatataactcagaaattccatttctaccctttgaaaaggaaatctatgtccatacgaagatttgtatatgagtattcctaacagcattattcataatagccaaaaattggaatacgatataacaaatgtccagcaacagatgaacctgacgaatggataagcaaaatgtgtataaccataaaactgaatagtatttggcaagaaaaaggacatgaactatacatgctataacatggatgatcttcaaaaactttatgctaggtgaaagaagccagatgcaaaagatcacatattgtataattccatttatataaaatgttgagaaaagtaaaatctatagagacagaaaatagatttatgttgtcttgcagctggaggtgggaaaggggagtgactgtaaatgggtacaagggatctttttagaatgacagaaatattctaaaattggatcatagtgatggttgcaccactctataaatatcacttaactgtacccttaagatgtgtgaattttatgatatgtccatcaaaacttgatagaactgtttttaaaatccagcaaggtgcatgccataacattcacaaatcttttgatacatgcacacatccatgtgactaccactcagatcaagatagaaaacagaaagttctcttgtaccccttcctaatcattgctcacaccctcctccacaagtgtagttaatactactttgctctctatcatcttgattgtttttttttctaatatgtacttttttctataatatacttaaatttcaatatagaagaaatcagtacagttatgtatccttttatgtctggtttcttttactcaatgtaatacctgcaagactcatccaagctgatgctgattatcagtagtttattctttttttattgctgtggagtattccactgtatgaatatactacaatttgtttataaattctcctgttaaaagacatttaggttgtttctactttggggctattgtgaataatgctgctatgaacattatttgagatatccattggtggacatatgaactcatttttcctagtgcatagctaggagcagaaatgctgattcaaaagggaagcaaacatttagcttaggtagaaactgccataaaattttccaaagtggttaaacaaatttaaactcctactaacaatgtctaaaatttccagctgtctcgcttcctcaccagcagttgttattatcaatctttttaattttagccattctgctgggtgtgtaggggtatactggtatggctttaatttgcatgttcttgatttacaacaagattgggcacattttcagatatttattgacgctttggatatcttctttagtgaagctccagttcaagatttttgtccatttttaaatagattgtctgactttttcttattgctttattctggatacaaatctttttatcaaatatatgaattaaaactattggtccccaatttgtggcttgccttttctctctcttaatggtgttttttatacttaatggtgtccataatttcaatggagtataatttatcaatactttcttttctagttagtgctttttatgttctatataaaaactctcacctatcccaaaatcatgaagctattccatgttttctcgaagctttattgtagtacctttcacatttgagtcttcagtcattggtcaaatgaagtttctaaaatttattattattttttagagatagggttcttgacattttgcccaggctggtctcaaactcctaggctcaatcaatcctcccacctcagcctcccaagtagttgggactacaggtgtgtgccaccatgctcaacaatcaaattaacttgtatatggagtcaagttcatttcttttcccataaaggtatccacgtgattcaccactgtttattgataaaatgattgttctcatactcaattgtggtggcatcacagccataaatcaggtgtccatattatacagtgatctgtttctggactctattgtgtcccattgttctattttatccttgggaaatggcactgtcttaattactaaccctttagagcaatcttgaagtagagaatattttcatacacaatttatttcagaattttgtgagctgtttttgtaagagaggcaaatgccaaaaatgaactatttcatgtcctatgtgtcatcatatatgttctttgaagaaaataaattccttaaccagtggaatgaaaacctgaatatttttcaccatatatggcctacaaaatctacataatctcttacattaattgcaggaacctgttcaattctagaatgaaaacaacttacctgagtaaggtagatggtatctttaaatgtgcgtaatggatctgtgctttgggggagtttgaaatgaagtccagcctgataaagcatttgtttgttaccaccttcgtgatgttgtcgatgaagtgaaaacttgctattgaaagaccagtcctctgtagacgagacctttcaaataaagaataagaattagaaatctgaaagttggcagtaaaactacttttctataagttcctgacaaacctggaaagtatcctaaacactagagaagaccttgaggtttgttctgtggctccagtttcataaatgttttaccatcctacttgttgccagtgaaggactagccttgtggaaactggaatcacaaaaccagggtttggtacatatatcctcccttcctccaactaagaaagttatattttgatgtttctcttaagactcttgttttatcaaaacatattcctggtttttgaaacatccactatatgtatttttaaatatcattttatctacttaggtaaacattttatctagtattcgtttgtcaaaacttaatagaatgcaatcaacactgttaaaactgtcacaattcttaaataggaataaaacacctattacactataatagggatactatgagagtagatgctttagcacttacactgttcacttgtttctcagtgattactaaatgaaactgatatacatatgtttaatttttatatagttgaagacacaaaccaaataatgttacttctctcccctaaaaaatcaattttttatggtttaagccaggcccaaattataggatctttattttatcccctaacttacaggatctttcttttgtcgtcagctcaaattaaaaaacaaagtaaaaaaaactcacatatgttggagtataccttctacaaaaaaagagaaaaaagcaataattctggcttctaggcctataatttaatgcactgttagcatttaagaaagaagacaattgctggctacatctgaaaatatccagagttttaattcaagttacacagactttgaaaaaacatactctgcccctccacccaaaaacctgaaaattaaaaaagcttaatccctgttcataaagtatgacttttcattcccagtaatcaagcaacacatgggcccattaccttaaaaggaaaaggttatccttcaggaactgattcatacccaaatataagaaatgtacactagccatattaaatttggaagtttttcctaattacagatgtttttccaaaatgccaccaccagaattaaataatgctaactactcctattatgtatttaaaggagagattcacattgacaatcatctcgcacactttttagacacacatcctttatcaatagtcttcctacgcttcctcctcttaatttattttatttatgtttattatttttaattgacacaataagtgtacacatttatggggtaccatgttataatttgatacatgtatacaatgtataaggatcaaatcaggctaataagcaaattcatcacctcaaacatttatcatttctttgtgtcgggaacactcaaaattatctcttctagctatttgaaaatatacaataaattattattaactatagttaccccaaagtgctatagaacaccagaacttattcttcccatctagctatacttttgtatcaattaaccaactctattgtccctccctggcaacccttccaccctctagtaatcattattccactctacttctttgagctgaacttttttagctttcacattggagtgtccttcctccttttcaaagtctgaaatatacctttgggccatgcagccttcttatttgtaataatttgaatctatcccataatcagtaaacctgatctttagttacgtgggaggctttctaccttctcataactatggtgtgaaaatctttcaaatttcagctataataatattaccagaaagaactggaaatggccaggcaaagttctaattactttaagaatattaactttttttaaaaaaagaatattaacttatttggtactcataaaaacccggccggatgcagtgtttcacacctgtaatcccagcactttgggaggctgaggtgggaggattgcttgagcccaggagttcaagaccagcctggacaacgtagtgagaccccatctctacaaaaagaaaaataaaaaatcagcctggtgtggtggcacatgcctgtagtcccagctacttgggaggctaaagtgggatgattgcttgagcccacgagtttgaggctgcagtgagttgtgatcacgccactgcactccagcctgggtgacacagctagaccctctctcaaaacaaaaaacaaaacaagctctatgagtaggtactattatcaccccattttacagatgtgaaaaccaggcacagaaaggttagataacttcttcagtatccaaatctaatgcagtctagctccagtccctagttcattaaacccagaaggatctgaagaaaatcgaactgtcatacaaatcatatggttaaaatggtctatactaaaggtaaatagtttacatttcatgggctctcactgtgtcaggtagagtgctgagtgcttcaatgtattagttaacttaatctttactcataaacacacgcgcatatgcagatctacatgcacacacacacacacacacacacacacacacacacacacacacacaaggtatttactaccattaaccccaatttacagatgaggaaactgaaattcagaaagattaaataatctgtccaagatgatacagataatgaatggcagctgtcatattcaatccagttctgtttattccaaagcccaaacttttaatcaccgtgcaatattgataatcacatgttaaaattatattttatgaaaaatcaatgtatcccaaattaaagagatatgttttaatcaagttgttgaatacatgaaagagcttctaaataaaagagccaaagttttatttagtttttcttttggtttattttattttcccaatcacctattcaaattctcaactaagcagtgtagcttaaaaaaagatgagtaaatcaagagataacaaatgattcataatgagcagcacttatcctcaactttttctattttaaaatatagtgtttattatctctgaacatcatcaggcatttcacaaaaatatgggataaaaataattccattatttgaaggaggccagtagaaattattatagatttaaggaaaaggtttagcaatttctaacactaatctttctaaagcgtggtgaaaagaaaatctatcagctctggagacagagagtaagtctgaacccagctacttattgtcgagaatgggaaggaaggaatgaaggaagcaagaatatttactgaattattgcttgtgtgccaggtcctcactcttttattagacaatactctacccactccactttgcctgaggcccaaaaggaaatcaaagcactgcagggtgggagatctatctgtgacctcttgcagtactttgatttccccctgggtctcaaagtggagtgggtagattattgtcgaattaaagaatgagtacgtggtacacagcaattattcagtaaatattcttgcttccttcattccttccttcccattctcaacacttgttcctacctgcgtcaggatactgaacttcatcctccttcactctgaaacaacagtattcccaaaagattagccccacaatttgggagcaattaaaaaacggggtatggaatttcacaatgtatatatgtttcaaaacatcacgtagtacacgataagtatatacaatttttcgttaattaattttttaattttaaaaaaccaaaggtagagctaaggttatgacatcattaaagttaaaagtacaatataacttcaatgtgtataagcaaattatagttgtgttcaggtagcgaaattgaaaaagattttgaaattgtcttaaaagactttttttggttactttatacaactgatgcagggggagcaaaatcacataatcatttcaatagatgaagaaaaagcacttgaaaaatgcaacattctttcatgatataagcactcagctaactagaaataaaagggaccttccttgaccttataaaggacatctactaaaaacctattgtcaatataacactaaatggtaaatcattgaaatgtactccctaagaaaaagaacaactcaaggatatctcgtcttcccactcattttctacattgtatgaaaagttctagccagggaaattaagaaaatgaaataaaaggcttccagattggaaaggaagaagcaatattattaatatctctatttatagatgacatgatcttatatatagaaaatgctaaagaatatcctccaaaatattattagagctaataaatgagatcagccactttgtaggattcaagcgcaatatacaaaaatcatctgtatttttatacgttagcaatgaacaacctaaaaatgaaattaagaaaataatttatttacaatagcgtcaggaagaataaaacacttaggaaaaagtaaaccaaagaagcgtaagactggtacactgaaaactacagtgttgaaagaaattaaagaagacatcccatgttcatgcatcagaagatttaatattactagatggcaatactcacaaactgatcaacagattcaacataatctctatcaaaatcccagctagcttttctgcagaaattggcaaatagatcccaagactcatttggaaatgcaagccacccaggatagtaaaaagaaatcttgaaaaaaagaacaaaattggtggactcacacttcctaatgtcaaaacttactacaaagctatagtaatcaagacagtgcatagtgacatgaaatatgccactggaacagaattgagaattcagaaataaaccctaacttttatggtcaattgattttcagggccaaaagaatttaatgggggaaagaatagtgtttttaatacatgctattggaacaactggctatacacatgcagaagaatgaacctgaactcctaccttctaccatacataaaaaataacccaaaatgatcatagacttgaatgcaagagctaaaactataaaattcttagaagacaacacagaaataaacctttgccatttggggtgaggcaatgatttctcagatgcaacaccaaaaagaacagattggtaagtaaaacttcatcaaaatttaaattttttgtgctgtaagtgataccatcaaagtgaataaggtgacaacccacagactgggagaaaatatttgcaaatcatatacctgataaaatcttatagccagaatatatttttttaattttcataattcaataaaataaagacaaataattttaaaatgatcaggccatgcatagtggctcacacctgtaagcccagcactttgggagcccgaggtaggaagatcacttgagctcaggagttccagaccagcctggatgatttggtgaaactccgtctctataaaaaatacaaaaattagctgggtgtggtggcacacacttgtagtcccagcttcttggggatgctgaggcaggaggattgcttcagcctgagaggtcaaatctgcagtgagccgtgaccactccactgcacaccagcctgggcaacaaagcaagaccctgtctctatttaaaaaacaaaatggctaaaggatttgaacagacatttctcaaaggaagatatacaaatggccagtaagcacgtgaaaaaaaaatgctcaacatgattagccatcaaggatatgcaaatttcctgtaaatgtaaattcccagggaaatgtgaagaaaaaaagaaaataacaagtgttggcaaggatgtagaaaaattggaaccctaatcccttgctggtagaaatgcaaaatggtgcaatcactacagaaaacaatttgacatttccttagaatgttaaagatagagctaccatatgacccagcaattccactcctagatatatatattcagtagaattgaaaacatgtattcacacaaaacatgtacacaaatgttcccagcagcattattcataatagccaaacagaggaaacaacacaaatgtccatcaactgataaatagataaacaaaacgtagtgtatatccatgcaacagaatgttattcagcaataaaaaaaaggaacatactaatacatggtcaacatggatgaaccctgaaaacacagtcaaagaatcagtctcaaaagaccacacattatattattccaattatatgaaatatgaagaataaggaaactatagacacagaaagtagattcgtagtgcctaaaactggggaggagggatagggaaaaatagggagtggttgctaatgggttcagggtttcttttgagtgataaaaatgttctaaaattaaattgtggtgctggctgcacatctctgtgaatatattgaagactattaaattgtacacattaaatgggtgcattgtatggcaagtgaattatatctcaataaagctattttaagaagaacacacacaatgctgaaacggaatctttaggaacagagagagtgaaaatccatacagaaaataaaacacaccaacatgatgaaaaagagggagagagaggagtggggtggggggggggtgggcggtggtaatggaataggaggagaaagaggagagaaaaggtaagatgacaacattagactaaggtttatttatcacatttaccctcttcctgtagtgaaatatccagctctgaatatctgtaaacggtaaaacagttgcaggatatgatttacaagcaagagttattgtagcaagtaagagttatttccgtgtgtgataataagtcaggcttaagcaaccactgggtcccattcagtgctttcggtgctcctgaaggaacacagtaaaagcaatatagaaaagtaatccccaaaggtttaaaaaaattattttcctccatcttcttctcaaactttcatttaaataagacgtaggtttcatatgattttctgaaccagtgatcagaataaacacatgcccacagtctatcattctgaaacattagaaaatcaaacgatgacttaccttttctaatgtactgaaggacggccaggactgatatccatattcagatgcaaatcgagcttttgggaaaactttccagttccagcaatcactgatatagtcataaaaatgtacatcaccaaaataattgctattagggttttgagagacccaggcttctgcaacagtttcagccccatttgtaggactggacgtaataaaaggacgactcttgtctccctgagttcagaaataaaatgaattcaaggataatatattcatcctgtaaagtatgtatcatttacttctttaaaaatactaacaagtccctgaaatgccaagtagctgatagaaaattagtaggaccacttaccttcttccctattcaacaaccaccagcacctctctgctcttcgccaatcctttatatcttttcataagtaacacttagctcatccctcacagcagctgttcttaatcttttcaatcatgttttgcctccactctcatccatcatgggtggtgtacagtctagtccagagtttcttaactttgacactattgacattttgagctggatacgtttttgttggggttggctggggttgggggtgtcttatgcattgtaggatatttagtagcatccctggcctctaccaaacagatgtcagtacccctcccccaaccttgaaaaatgtctgcaggcactgccaaatgttccatgggggcaaaatcaccatcacttgagaaccacaggtctaacaggtaagaacagaagctactgagtcagatggacccaaacgtgactttaaatctcaaatctgaaccttattatttgtggacaggtctaagccttggtagatttatctgtaagatgaggataataatagtacctcctttagaggtattataaatagtaaataactctcatgtgaaagtaatggctaggtgtccaccaattcatgttctcgtttctgtaatatagagccatccctaggaagtggcttcctagcccatatggggccatgtgcctcattctcatcctctgcccccatttgcagctgagggtgcaagagatggtgcagctggaataaggtgtctatatctctgaaagaggagctgccagcagccctttcatagtgtcagtgaggaagaaatacacttttattatgtaaaccactgaaatactgtggcttacctgttacaacatctagcatgtaagcacttaacagggtgcctagcacactgtgagaactcaaaatatagttactatcatctcagtagatgagactacttcctatttcactgagaagattcattcatttagcaagtattcgtcaagtctattgtgtctggcatttttccacactgcagagggagggagagagacagagaaagagagagagagagaaagagagagaatctatgactctgtcaagtacttatacaacaaatctcttttgagtatttcctattggccaggcatgcagttctttctatgtgctggaggttcagcagacagccatggtgaccgtcttggaagagtagatggcaatttagtgctgaaaccagatactgaacaagtaattataagtatgatgaatattttgaaggaaaagcgcaaggctctttgggaatgtaaaacatattacagaaggccagtaagccttccctgagagatagacttccagaaaataattttctcaacttttcaccattaggtttcactttttcgtggtatatccattcatatttcatttcttgtttctattctgctattaagaaaaaaaaatccttaaccctttcctttgccagactctgtgttctggtcatctttctagtttgctttggtactatagccaacaaactatcttccactccatttttttcttaatctccctctactgcccttttcccttagcttccttaggactccctttatcctaataaaaagtccctttgatcccttgtagtccatcagatttctttaccatcctctcattcctaaacccctgacattcatttcctgatcatttcactccactgaaatgtttttcaaaaattacccatgaacttctacttactaaataaagcagttctttctgtccccacttattccctctcaggtgtgcaataaatgaccctatttaccacctattatttctgaagctctctccactcctggctgtttgttcacaattcttccacattccagtttcccccaaccttcctgattcttccttctccagctaccctctccatccccagatggacactctacctctctctcaggcttctccttgttctacaccctgtcccatggcttcccgtcacatggatgttctgattactcctagccacacctgcacacttgacctcatgttcaccaccacacattgctgataaccagctccacatttccacctgtgttgtcttgccaacatcgcaaatccaaccttttaaagcagaattctttatttactaattccaaacttatctgactatgctccctttcttgctgaacggtacccagattggagtcatcttcaatttctccctctcttacctcccacattcagtcactctgagtagtagcaactctacattcagatatttttttccatcaccgaatttccaatcccacaccactggactccactacctatgacctccatgaccttggggacttaatgactctaaaataaatatatcacctacactccaggtaacttctaaaaattaagtaaataaattatacaaagcacttacataattaactttttaaaaatttgttttttaaaatttaaaaaaaattgttaaaagacagaatgttgcccaggctggagtgcagtggcatgatcatagctcactgcagcctcgaccttctgggctcaaaataagcctcccgcctcagcttcccaagtagctaggactacaggcacatgtcactatgcccaaagaattttttaaatttttttggagacaggatctggctacatcacccaggctggtctcaaactcctggcctcaaatgttccccctgcctcagctcccaagtcactggggttacaggtgtaagtcaccacatccagctttaatttaatatattaatatataataatattaatataataattataattaatatattgatgcctggcatctcagtaacttggagttcttagttgttataactggtttccttgtttagaacctctcacctccctaatctttgctagtaatcttccataaacatggaccagataaagttcctcctctcccccaaaatgtccactagcttcccaccatctaccgaataagctcaactccataatatgatttaaagtccctctatgacctgcttccagtcttcactaccttccattctcccacagtaatccaggagtcccttgctcttaggcaccaggcactgcttgctgctcattatacataccacctactttcacatctttttacctttatttacattgttttcatgacctaaagtactactagacaatgctttgcctcaaaattctccacctgtaaggtttcccttgaatgtaaccttttactcgaaagcctttttagattctttcagttaaaattaatggttctgccacatagttcccagcattttgaagctacattttttatagcactttttttaactgcccaaggtctgataatttttcccatgtttccctttgacagcagagtgtaagctccacaaagataagagtgtcccccacagcatcgggaatgaggctttgctcttggcaataagtactcagtagatgttgggtgaatttaaaaatattaaaaagtatgatgaaactataggtgatactaaatgtttaaaaatatttttgctacaatggctttgaagaacattgaagaagaaggccagtcaattggccttgattgatcaagcttgacagatttcccttcattccttgagattcttgagaaatttggcacgctgagccatgcagtaaaattacaaacaagtctctacctaaaaatatctggctttgacgatgcattataatttccttccacttataaatcctttattcttgaggtgtggttatttgttgcaaatctcacagatgacatctttctaagccatgaccttaaacccttagttggaccaggaaataccataaggtgatccaagagaatggccataaaaagaaagcatgtgcagcaggaaaccaatcattacagccaatttgtagatgaatcaatttatggtactttccctttttatgatgcctaatactttgatggaaactaaaagcagtagtggttatgtagcttttaatactattcatctttgaaaaaatttacaaacatcagttattgcccatggctcgttttaagataaataagtccctaaaaagaaaggcatatctccatttcagaggtaaaaaagaaatggcacaaagaagctaattttttaaagcttaagaatgtagtgttaaaattaatgatcaaaatgtgtaagtatctgaagatctaccttgttgaacaaaagcaataaggatgatgatgatgatgatgacgatggctagttttaattaaaaggttactgtgggccaggcgtggtggctcacacctgtaatcccagcactttcggaggccgaggtgggtggagcaggaggtcaggagattgagaccattctggccaacatgctgaaaccctgtctctatgaaaaatacaaaaattagctgggtgtggtggtgcatgcccgtaatcccagctactcgggaggctgaggctactcgggagaattgcttgaacccaggaggcagagcttgcagtgagccaagaccgcactactgcactccagcctggtgacagatgagacagatgagactccatctcaaaaaaaaaaaaaaaaaaaaagttactgtgaaccaccatctttcagtaattcactacaacgatgacacgcaaagggaaagaggaaaggcacctgatattctctaggccttttagaaaatatggagttgttcctttggccatatacatgtgaatctacaagaaaggtgatgtagacatcagggaaatgcatctggttcaaaaaggaatgccccacaaacgttaatgtgggaaaaccagaggagtctactgtgctacccagcatgctgttggcactgttgtaaacaaacaagtgcaagattgttgccaagataattaatgtgttgagcatattaagcactctaggagccaagatagctccccaaaactcaagaaggaaacaaaggaaaagaaaaagaaggaagccaaagagaaaggagcctgagttcaatggaagcacagctggctccacccagagaagtgcactgtgagaaccaatggaacagagcctgagtttctagaacctgttccctatgaatgcatggcataacaggtgtttaaaaaataaaagagctctggactgtaaaaatatttcttttcattaagcagaaatgtgttgtcccctgccccaaagaaatattttaactttaaaaaaaaaaaagttactatgcgtcagactgagtcatgtgccttccatccattatctcacttagtccacataacagctcttaaaagttagctcctatttttaacctaattttatagatgggaaaaggaggattaagtaactcacccaaggttacatagacaggaagtggcccagccaggatttcaaagcctgcatacttaaccactatgctataaaatgaaaaccctcagaaactataaatccatcaaacatgaaaaacataatatcaatattgtgaataaaaagattataaaataagtgttctgtaaatattttttaaaatttgtatcatcacattttgtgaatagaaaaattcttcatgacacatgtcttagtatatcaggtaaactataaatttgaacccatgtttttcatgaattctcaatgaagtttcttctataaatggaatagtgccataaactgggcatgtttaggtgctaatatcacatactattttaaaaaatagatgccttttcaaattgcttctggatatacccagatatttaaaacatctatttacagacacaaaagtgtaaagacaaccagattattaaatcacatgttaaacaaagtttttcaaaagttaaaacttttgaaggcattactgaaaaaaatgctgctttttctcacaaaaaggccaatttatattaacatatgtctgtataatatgccaattagacaaacagtggtgcaaagagaaccactatagagcaagggccatacagcggggttggagaccagctctctcatctctctttgtcccttaaatcacataccaggacattcatatgtgatatataccaaagtctactactttaacacatacgattacagaattttagaagtggcatatcaataatcatcgaatctagagattctaaactttttgggatccacggatggactccaaggagcatgtgacaacctagcattgtaagcactgcattggtgtatgtgtggagagctgcacagagaagttaatcctccaaaaagtccacagcccatgaatcctttcatctgctgctgcactacaatgggataccctgtattcaaacgatactgttgaagacagccctaaaaaggggcataaaacatactataccagtattcaaacttatccactttaaacatacattcttttttttttttttgagacggagtctcgccctgtcgcccaggctggagtgcagtggcgcgatctcggctcactgcaagctctaccttccgggttcacgccatgctcctgcctcagcctcccgagtagctgggactacaggcgcccgccaccgcgcccagctaattttttttgtatttttagtagagacggggtttcaccgtggtctcgatctcctgaccttgtgatccgcccgcctcagcctcccaaagtgctgggattacaggcgtgagccaccacgcccagccctaaagatacattcttaaattctactgcattaaaaatcattacttactgccagtacgagctctctgatgtttttcacatagagtgtcacatagtccttgatgtagattggccggtcagtgaaactgatatgataccaattcatcatcagcgcctcctcattttcattattgccactccatatgatgatagaaggatgagatttcagtctcttgatctgaaaattaagaaaacataaaatgattttcaaagagttaacataaaaaattcagagctataattactcataaaattaaagcccttgcatttctgcacataaattcttatgtgccaaaaacctaatttgaaaatggctagtcatgttagctgcaggaatacattttaagaaatctctgagattctttttaactagattttataaacactgatacatagggtttctcttctctgctatataaaaactgaagataatataatcccttttttagaaagagaaagaaaaggggaatgaataaactcttcactctgtggattgccacaaagaaaactttcaggaaatacaaaaggcaggagacattatattttggggattggttcttaagagcaaattggacaaattggagttctgtgtgaagaaataaatgaagcaaagcaaacactaccactgaaagaaggacggaggttcctatgcagtcctcactgagatcagaaaaccagaaggggaactagagaaggttttacaaagcaagtgagtactagaggtatgctggcagttaaagacaaatatggaatactctaaaggaaaacagattagggcaatcagggttgatgtctcctgaaataactatcaatgtcgtgtcctgagaaatcaactaacattaagttactgaatgtacctaaatataaaagggaaaattagagaatctacctgaaaaccgtgccacacgaggcctgcataaactgagctcatctgggctggccctacataaagacaaaaggatccacttgtgttatgtttgcactggacagattcagacatgtcccttcttctaatacactaggacatgtgccccagtagagagcaattaaattcctctgagaatggcagagtgagtcaatggtcaagaaaaattcttttggaacatgttttggcaatgttacctcattgatatttataggttcaccttcgctgtgatgcatgattacactgattgccccccactgatgctctcaatgtgttctccattcaagaagctcagaaactcacatagatgaaatagagatgcactgaaggtatattaaagagatatatttcatttttaaaaaaattaagtcttgtgtttttctcagccagccatataaacactatttcctttttttgtctttgtacatgcccaagaaagggacagctgctaccaactgtgactgacatatttatgccactgatgaaaatacaaatataaatcctgaagtggcaaaaagcttcagtagcaccgtgttacacacaaccctcaagctgacttagagttttatggtaagctttactttaaaattttaacaaactttgcatgcaatggctctccttatctttaataatgcatcaaagaactgaagatacataaatgttagattttaattatttatacgaaagaaaactaaaaataaaactgaaatgcttgcaacctgtgtaactacaattaatatgtttacagttattcattcatccattcatctatccactttgtgaataatccacagagtggggacgcagaggggaatgagtcctaggcctcagggagatgacaatcttgcagaggtgacaaatccttgaacaagtaattcaaagtgtgatgtgtgtctcaaaaggcaaaagatttttcccatgcttaaggtaagaggggccaaaggagaacaaaggaggtggctcacaagggcagtggatggggaagatgttccaggacatagacagcaagatggagatggtgcctgaacaggtgcagacaccagctggccggagtcccgcattaagaggatcttacaccttacccagaggtcaagaagccacctcaggggaagtgttggctagggaaggagttcgattgtactttttaaaccttttattttaaaatgaaacacagttacagaaaacaaattatgacacggtcaattatcataaggcaatcacccttgtagccaccacccagtgcagccaggccggaagccatccacgtgcctcttcctaatcacagccccttcctccttccaaaagtaaccactatctagagtatcatagtgtaatagaaatcgcttccttgcatttctgtatggtttttcacaaaatatacatctgcagacactataatatgaactctagattttaacacacttgatggattcaattcattgacatccttatctttattgaatctcaaattgtcccccttttggttgttcagagtctctcaaaatccttttgacataactttgatagcttccttgttatctgcatgttgagatattccaggatcagggttctgagcaggaatgtggtatgacttaaaatgtgtcagtggaagatgactttggcagctctgttgagtatgcacatattgaaagagaccaatgctagggagtccaatcagaaaacaaatgcaatgattgaggagagggaaaaataggatttgaattagagtagtaagcacgggggtgagaaagtaaatacaaatactagtaacattgatatcaaaaaattgtctcaacttaaaaccagatggatgtgggaggtgagaaagaagaaagtatcaatgactttcatatttcctgctaaaaagaaaaatcttgaaagagtgcactggggaaaagataatagatgtactttgaagacacgctgagttagtgtgacagctgctattatttgttatttcttttgaactgcatgacttacacgtattatcctatttaatttttgaaacagtttcatgaggagtgacatcatactagagttatagatacagaaattgaggctcaagaggtaaagtgacctccctaaggttgcagactcaccattcaagaagaaatatcaaaatatttgttctttgtatatcaacattacaaaaaatctggcagacagttggacatgagaaattgaaatcagagtcaataattatccacattgtagctttacctgaggttaccgagaaaatggatttgtttccttctttaacatgttgcagagcactataaaaactcaatatgtctccacagtcttgcaaactctttacaaggtaggggtgatctcctggtgcagtgatcatttccaatggatgctaatgaatcagtccgatgtttcagtagtattttactagcatatgatacactcacaagttggtttctaaactgtattttgggagtacatcataattcagaattttcatgtattgacaagcatcccactctgattctacatggaaacccatgccatgcacttaatatttaggggagaggaaatataatgcaatctgtgtttcaaagcatgatcatcccctaaacagaccttgctgcaaaaataagtatattcagcacacagctcataaacctcagatctgtggctaaaattatcagttgataatattatattaacaccattgccatttgtgaaaagaagatatccaggatcattttatatatttcctgtgccagacctggagtcggccatttctctaagaagcttttctcttaacaggaaagattacttcaatataagaatactcaacactacaacgttgggcattatttctagatcttttcagtaggcagagaaagcatataatcacttccttgcatttatatatctgtgaatataaatataaatgtcaatatgtggaatctaaaataaatcaaggaatcaataatcaatttaaactttctcctgagcaattcaaacagtggtgttgctgtttgctgagatggagaaaacttcagaagaagcaagattggggagggggtgcaatataagtttagtttgtacatgttacatttcagatgcctgttaaacctccaagcagaggcaccaggtaggcagttggatataagaaagaggaattcagcagagaaatcaggactggggataaatctgggagtcatcagccaatagatgatggtaaagccatgacactgggtacaatcacctaggatgtcaattacctggctgtgtaatttttcatgggatttagtagagaacaaaaaccaaaatgaagcaagatttaacaaaaggcaatactaaaacatattatttgttttatttcttcttggaagggtagtaacatacctggtaggcaacttctgctgtcactgaatccaggaagccctgatcagttggataaagggcacaggcaaacataaaatcctgccatacctagcaaatcaaataaaagggaatgcaacacttccataagttttattacacagaagaaagtctttattctgagctctgggcattatctttcacacaaatgaaaaatccagttagcctgatgagtgtgatcactggggcgccattatgcataatttgataccaagaaatgtatcaaagacattaggacttcccagaactgcacaaaatctgagaagagaaaatcctaggcaggtatagaagaaagagaagatggaagaatttgaaaaagaaaaaatgtgtggaggggacacagaatgaggcttccctccagccccttgtcactcctaattcattccaattttcaccaggcatttggtattgagatgcaccagactgttaagaatcatacttcatttataaaggaattagcttttcatagacaaaaggattactacatgcacattttagtaatgaaaccatataagtcccttcctaaggaggctgtgtgatgcaatggttaagaacacagcccctgctgggagcagtggctcacgcctgtaatcccagcactttgggaggctgaggcggggcgtatcacctgaggtcaagagttcgagaccagcctggccaaaatggtgaaacccggtctctactagaaatacaaaaattaggccaggcacggtggctcacgcctgtaatcccagaattttgggaggccaaggtgggcagatcacgaggtcaggagatcgagaccatcctggctaacacggtgaaaccccgtctctactaaaagtacaaaaaattagccgggcaaggtggtgagcgcctgtggtcccagctactcgggaggctgaggcaggagaatggcgtgaacccaggaggcagagcttgcagtgagccaagattgtgccactgcactccagcctgggtgacagagcaagactccgtctcaaaaaaaaaagaaagaaatataaaaattagccgggcgtggtgacacacatctgtaatcccagctacttggtaggctgaggcaggagaatcgcttgaacccaggaggtgaaggctgcagtgaaccaagatcgcaccactgcattccagcctaggcaacagagccagactccatatcaaaaaaaaaaaaaaaaaaaaaaagatcatagccccaaagcagcctgtctgagtcggaatttcattccaccataaatgagttgttagagtttggataaaatatataacctcttcatgtgtcagtttccttatctgtaaatggggatagagaatagtaactacatcattgaatgggcatgaagataaaatatgtagagcacttagaacaatgcctggcactcagagaatattatagaatattgtcatcgtcacaatgaccatcagcattatcattattagaataattcctagtcttcggtggcactctttatattttagaacaacaataatagaactaacagaatatattttctttgctttatcctcacaattgcaaaacacattaaaagtacttaataacaatattagggccaggtacagtggctcacacctgtaatctcaccactttgggaggcagaggcaggtggatcacctgaggtcaggagttcaaggccagcctggacaacacggtgaaaccccatctctactaaaaatacaaaaattagctggatgctaatttactaaaaatacaaaatttagcacatgcctgtaatcccagctgctccggaggttgaggcaggagaatcgcttgaacctggggtggaggagggtgcagtaagctgagattgcaccattgcactccagcctgggcaacatttttaatttttaacaaattaaaaataaaaaattagaaaaaatttagaaaaacaatatgaaacacaccttttctttacttaattttattatttttcttctctttaggtttcgtcagatctcctttaagtgttttaaatattttgttttcttttatatgcatacctaaatatcacaaagaaaattattttaaaagtaggtatatgtatactgggatataaataatttacaggatatctatcatttaaaaataaataattatggtagttgatcacctatggctcttggtttacaagatgccatttattcctatagccccaaatggaatatcattcctagctctgagactggggcaattgcatcattcagaacattggcagtcaaactgaggatatagtaacttatcaatatataaaatgctatcaacttctcaccattattcctagttcatcacagagttcatagaattcatcctgctcataaattcctcctccccaaacccgaagagtattcatattagcatccacaacagactgtaaaaggagccgtaacctgtagaagacattttagaaacaaatcataatttggaaaaaaaaaacagattgtgacagataaacacatttctaatctgttagaaaaacacactctaaaatcatgatggtttggttacaatgtaaattaaagaaagtaagataaaattatatacacattaactataaccacataaaacaaataaacagaaaaagtatgggtgatatctttacctattaaattttcagtaacattattatactctttttaaaattaaatttatgttttatatttagtcttataaaaaatacagttgtaagccttggaaagtatgcactaattttatacaaaccctccaaactataaaacaaaatcaagacttgagtattagtgcctagcacccctatctccttttatgcaatttctccagcccagtatttctttctctagtaaatttcctttctactttttccaattcctattcacattaccctcaggaaaatctagaaacttacaggcagcttgagagcatgtaccttccctccattcccagaacagtgctcaaaccaagtaacaggctgggcagacccagagcactgtgggctcagcacaggcaccacggcaggcttaccaattggcccagttgggctgaaggaccacagccaacccagccccagctgggaggggagaggagcatttgaaaaggaaaaagatagagccaattatcccgtggctgtgtctggagaagaatttcattttcttatgaaatctaaaataatatacacattttaaagtaaaaggaaattactacaacttttggaaaaaatcagggtttagttactgatgacatttacattctaaacatcaaataatatactacaatgcacatttatacatttgtaaatatgctaaaatgttatttaatttagataataaataagtttaaatgtgtttattttcatttcataaagtttattttcagcattgcaaagatttaagtttacagatccaattaggaaatattattttcttccaaagttctattccttcagtcttggaaaaacattttttttcctagatctagaacttttaagattatattttgtttttaaataaattgtattgtgtatatttaaggtatatgacataatgttatgggatatatagatagatagttaaaaggttactatagtgaaacaaaccaacgtacttaccatcctacaacaggggtcccaacccccaggccacggactggaccatggatcaggtggcacagcaggaggtaagcagctggtgagcaagcattactacctgacctcctatcagatcagcggcagcattagattctcataggagcaggaacactattgtgaactgtgcatgcgaaggatacaggttgcatgctccttatgagaatctaattcctgatgatctgaggtagaacagtttcattccaaaactatcccctcatcccccacccccaatctgtagaaaaactgtcttccatgaaactggttattggtgccaaaaaggtttgggactgctgtcctacgtagttatccactcttttttgcttttgtggcacaagtagctaaaatctactcacttatttaccatgaatcctataaatagcacaatttttttaacctatattcctagtgcacatcagatctctggacttgttctcttgcatatctgctacattgtatcctctgaccaacagctcccagtttcctccccaccctcccacaaccgcgcctccactacacacgagattttgtttagttcttttgttgagataaaagtaaaagaatatgcaaataccttagcatagaaaggtaaatatggggttggcccggtggcttacgcatgtaatcccaacactttgggaggctgaggcaggtggatcatttgaggtcaggagttcaagaccagcctggcctacatagtgaaaccccatctctactaaaaatacaaaaattagctgggcggtagtggcctgcacctgtaatcccagctacttgggaggctgaggcaggagaatcgcttgagcctgggaggcggaggttgcagtgagctgagatcacgcgactgcactccagcctgggcaacagagcaagactccatctcaaaaaaaaaaaaaaggtaaatatgtgttcttatctttcaaaaccatgctcaaaacatttaacgtatcatttgaaaagctgaaaatagttgaatgtaatatttttttcggagactattcaaaatataaattactcattttcttatttctccagaataaacatataatagttttctaaaaatcgaatggcttcaacagtctcaaatagtttagctgtaagaccacctgtaacccaggagaatggaatatataatttttaaaatcctgtccattctgaagtttccatcgtctagaattctatactacctcttagttccttgcccagagactaaagaaagtaaaaatgagtaaacctcaagctttgcgggactgctaattaaaagaagaacaagaaaagaaagacaataacttacaactcagaggttactcggtcctggaatgaatctgctgggatccagtttgagccttttagaaatatgggaaatccattaattttgaaatagaaactcaaaccaggagacccttttataggctcttctataagttccactgtcctaaaataaacctgcaatgaacagaattaaatgatgaatatcaaatttaaacataagcaaaatagtttttttaaaaaaagcagacctttttgaaaaactacattcagtagtttaatgctaattttcctatttactatgaagcacataatgtggaaatgcacatttcaggaatatacacatataaattattgctagcatccgttatttctcttttaaaagagaaatatagaaaccactaaagagctactgtagtcttccacatgaaataggcatttgtgataacatcaaaaaagacaatttgaagataacatctctaaattaaaacaaaaacatgctatttcaaaaaaatagaaaaaaatgctgtctttgaaaaacacattctcatttcagtgttgttaaaaggtagccaaacatgcatcttagaatcaaatgttataacttaacaactttgcaatcttaataacacattaccataaaatcactttgtttaatgggtaatttaatcctaattacacattaaactcaatgtttgagcacgctctggtttcttgactggagatgtacatggtgttctaatggaagtagatgcagcaggaccacgcactctgtgctattggtgctctggagaggaagcagaggctccatcctagtgacagcctagccaggttttcccccagttaagcatgggcagcaagaccccagatagagaagctttgacatttttatcaaaatctttattcttgccagccataaattggatcaagtttatataagattttataccaataaagcctagccttaagccaaaagcacacatttctctaacttaaaaaatcagtgaatgaattagtcaaattatttcatgtaataaaagtgtccaccattctcctgcttcctgactcctgactttatttatatgaaatgacaaaagacctcagaattaactttacaagaagatacagaatatgtcctggataaggaggatcttgacacgcgatgatcactcctgcttcagggttgcaaaatgtcaagaatgcacagtgattttcagaggtgacttttaaaacaccatgatggtgggttccaatatctagaacagtgcatggttctttaagtgtggcctggggactccaggaggtcccttggagactgtcagtgtgtccttgactttacttagagtaaaactaaaacattatttgcctttatctctctcagtctctgagtgtcagtggaattttccagagactacatgatgtgtgcctacttcatcactctgacagctaatggaatgtgtgctgtgtattccactgtgatgtagctctgcggcagaggtttatggtatgaagcagtgcattttcagagattaactcagtttgttctcagtacttttactgtgctcttactattaatagctgtctttgattattcctgctgtaatctctgtaccctcattgttgttcaataaattcttactttgaaccccaaagtttcccttgcaacctacacaggagcacaaaaggagtaggtactacttattcctttgtttcacagcaatatttttaagttttcaaataaaaacaaattttaattttaattgaaactcattttacactttaataatattttatcttgttctaaaagaaaatttatttataatacttttttccaatttagggatgaattgtcaaaatgggattagaaggcttaccttctcaccagcctggccaacatggtgaaatcctatctctactaaatacaaaaattagctgggtgtggtggtgcatgcccataatcccagctacttgggaggctgagacaggagaatgacttgaatccgggaggcagagtttgcagcgagccaagattatgccattgcactccagcctgggctacagaacaagactccgtcttgaaaaaaaaaagaaggcttaccttctcaacctataactgcactatctgtctatatctgaggatgctgaaaaaagtgaaactgacatatcagacagtcttttgactcatggaagggaagaatctactctaaacaaactgggtaaaattatgaataagaagtgaaattatgatgaaagccacctttctcttgactttatggatgttaataacttacctttttgtgcgttatgcaatggaacatttaaaaataatatttatggtgccagttaagttgtagtgtctcattgagacaaatcattcacagtatgaagaaaagagaattgaatatttaaacttatacatgataagctcattaaaagtcaaacagtgtttattacatcttttcaaaccagacatgaaaaaacccagtgaagcatcttacagggttagttatgcacccctggctggagaagcacacatactagctgagagacagttgtactgttgacattgcagaatgcttactagatgaaaagttagtcgaggaaataacagcactgccactttgcaatgacagagtaactcgtccaattaagagatttgactgcaatatgaagactggcctgatatctcatctgaaataatcatacttttgctttacaaatgagtgaatctccagatatagatggacttgccagtttgcctgtatttgtctgttatcagcacgataaatcatcaaaaaacttcttttctgtgaatttttggcaacaatatacaagaggtgctgaaatattcaaagtactaaataattttttgaataatatcctgtaattactgtgttaacatttgcactgacgttacaaaagcagtggtgggttaacactgctggtgccttagcaggaatcaaggcagtagctccaaactgctagtagtcattacatctttcaccttcatgcattagcagcaggaaaatgaaaaaaaaacagtttcacttaagactgtccttgataaagcagtaaacattaatttcattaaatcccaaccctcagtatgcatcattttaatatcctgcattatgaaatgagcaatatccataaagcaccattcacaatagatagctggaggaaaagcctctgggccattaatagagttgtatgtaagctgaattggccttgttcacgacactccatttttacttgatagaaagaaggactgacagacaaacgatggttattcagacttggatacctggcagacattctctagaaaatgaatggagtgagcctatcatttcaagaaaaacaactagcagtatttgtggccaaggataaaattcaaactttcaagtaaaaattgggattagggaaaacttgtatctactacctcacggtagtagatactacttaaatacttaaaaactttttagatgacatcagtggtgatattaacaaatgtgatattataaaaggaaatgtttcaacatttggaagatctgtaactctcaagaaacaaacattttccaataaccaatgcattatattacaatatcacataatatgggtaaagaattcacacaaagtgcaagatagacaaatgaattttaatgtaacagagaacaaaaagtttaagaaactatcatttgttaaaagaaaactatcattggttaaaagaaaatccacaatttatctgaaaagactattttttcccttttccaagtacatctgtgtgaggtcagatttccttaatctgtttcaaccgaaacaacatattgcaaattgactgaaggcagatacagatgagaatccctttgtctcctactaaacaagacgttaaagtgacttgctaacatgtaaaactgtcattatttccactggtttttttggtcaatatattttttataaaataagtcatatataaaaacagtcatatgtgccatggtttattatggttatttaaaatgaataagtaaatacttaattctcagttttaatatttaatatggtaaatatcggtacatataacccatataaacaaaagcatgttggggttttcaataacttttgtaagtataatgcagtgctgagtccagaaaaatttgagaatcactactgcagaaaatagaatttatttgtttcttaatatacattaatgctacaaattgtattaactatacaacataacactttccagaatatttttcctttctgtgcaaatgttcttataaaaaggcatctctccctatcccccaactcttgcaataacaagttatgactggggtgacaataaacccaaaccacctgacagtgcctcagaggtgaagtagtaattaccagccacctttccctctgggcattctttcacaagtgaaaggctcccgcttctatgataagtgtcagtaattttccacgtcctctggcagtcttgatagtcacataaaagccttcttctacaacaggtattttacttcagagaaaataatgggttctaaaagatttcttgaaaagacccttgagtaacacatatttgcatccaaagtaaatatataatcttcatatgagactaaaattttttaaacagtccaacaaagcaaattattgtctaacagtaggaaaaaggtataaatacctaagaaactaaaaaatgtgtaagtcgggcagttagaaaattaaaaattttaacttctaaatttttatctatttttgaagtttctattcctcactagatcagtgtttttattagcttcaaaaagatttcattttcaaaatagaaggattaactttaaaagtgcaggatagttgaatgcattctttcaaacaagaattaaggatatctgaactaaagggcctaagaggtacgtgactgataaatacggtactcctcaaatttctttctctggcagaccaaacagatgatatgtaatgaatcattgattcacaaacccaaggctgcttctcagctgtttgtatcagatacttaaaaagctgtaatagcatcactacattttcaaaagggcaattttcttcttaaaaagaaatccacttatttctaaacattgtcaaatgtcaaacctgctaaaatccttttacatgtattttaagagacaaccaaacactgcatttctgtctttgttctgaaagtgctcccccatgtaaaagtattgagaaaacaagctctgggtctccacaaatagctcttgtcaaacaggtctgtgcaggatgacacaagagacattctttgtcgtgcccttgcaatttgcagacagcacaaccagaagttaacagattaacattgacatcggcacagttatgcatccttgtagccagatgtgtatctagtatatctgacaccagataggatcactttttaagacctcctcttccatatgacaaagttattttcaatagaagtaatgaaatgaaatgaataatgataatgtccagaaaagaatgtagacattaaaaattttctttccctgaactttgtataatcacgccagttttttaaaaaagtaaaacaaatattagcgtacaaaaaaggaaaagttaatagattcaagttttgattatattaatatatttaataaaattataaacaaagggaataacatatataatggtatgctatagtaagaaataataatatttgctattttcagccttaccttctaaaaatctgtcaacaactttctcaaaattgatcttctttggacatacatgttcaacaaagggtatagccagctcttttgatttatttgtcatagctgatggaaaaacaccttttattaattttaactcagaaatgttcttccagatgaggccagagatatgcaaatattttagaaaagtattaaacataataagtttggtagagattcataataatcccacatcacattaaactccaaaaaaatgcagtcatatccatgcctttgttcttttgactttcattcaaacaatttacaaatgcctctgaggtataaaaaaaaaaaaaatcccacttctcaagtatttcttctgtaaaatcagagaaaatggctaaatgattgtgaacacagatactatttgattaattgctgtagaacaagtgtccagttctcagggacaacaattggggcgtttggcattgctatgtggatttctctgagcaatggaaaaccagcaactctttgttgtttctcctggcactctccttcaaaatttgattcttttttctatgtaaatgttgatttccttatattttgttgttgcacagtaaataggcttcaccaaaatttctgtgcacttatcttcaaagaagaattttaaagtttggtatttcactgtacattgttcaagatggagtctatttgcaaatatttttgtatctgattaatgtcatctaaaactataccagaaaaaagataattccagagagaaaaccgcacacagcagagagaaatgtctgagctgattcacgtgtccacattttctttggattacatggtacttcagagttgagattaacttttcaaaatttttctactgtggcccagcttcataatgaaccttccatcttgtctaggaaagcttttctgcagcttttcccatcaatgaggtgagatgagaaagaatgaatacaatttgtccaaagttctaaaaaaaaaaaatcacacaggaaaaaaaaagtttccaaaaaagcaaattccacaaggctcagagaataatttccaagaggctgaaataaaattttggattaatttctttgatttttgcatgaactccacagtgaatactggccacatatgcagcatcttttatcctggcccatagcagaggtttatgaaataataatcccattccttgaagctattttctgtgcattctgcagcagttgttctggaaatatgagaatgactcctttatctccattctactaccttccctatgaccagttcacacatttgatctctgtttccagaaaggtaagaatgacttctttatttccactctgccaccttcaatataggcctatctgaccaattcacacatttgatctctgtttaaagtatccagagtgctgtcaaaaagaattccagccaggcagtggctcatgcctataacctcaacactttgggaggctgaagcgggagggttgcttgaggacaggggtgtgagaccagcctgggcaacatggcaggctgtgttgcaacacccacttactgtctgcacctaaggctaactactccccatctctagaaaaataaaataggcaaggcatggtagcatgtgcctgtagtagtcctagctactcaggaggataaggtaggaggatcactggggcccaggagttcaaagctgcagtgagctatgagcagcctgggtgacagagtgagcccctgtctctaaaaagaacaaaataataataataattctaaagcatttttttcagtatctgccaccccctactaaagcataccactgatgtcatgttttactttgactctttctttagtttcaaaacaacaaatttaaaaaaataaatttcaattctaaagacactattaaaattagtagaatatacttcatacatgaactaaaatatgcacttaccaagcaaaatattacacattacacctcagagtccatagctttctcaactgtaaatttaaagcataaaaataactccaagagatcacatcgaattgaagtaacttatgttgagtttctccttttttataatcactgtgctattgttgtttatttctaatctgcaatgcttttaaatgcaggcatgtatagggcagggaatggaagcacaaactgtgttcaaaacaagctcatacaattccaaactgttataaatttgctttcaaaatgactgtatgaagctgaatcttcatgtatccgggaatgactgtataactaagagtactccaggccaggtgcagtggctcacgcctgtaatcctagcactttgggaggcagaagcgggtggatcacctgaggtcgggagtttgagactagcctgaccaacatggagaaacccccatctctactaaaaatacaaaaattagccgggcatggtggtgcgtgcctgcaatcccagctactcaggaggctgaggcagaataatcgcttgaacctgggaggcagaagttgcagtgagccgagatcacgccattgcactccagcctaggtaacaaaagacaactctgtctcaaaaaaaaaaaaaaaaaaagtactccaaattaactttcatgtagaatataatgtctattacaggactggtaataaaaatgtgccaaatctaagcatacatgtatattattaacattcaagagtaaccaaacacatagttaaaacttagaccaacatatgattggtggagggggagggtaggagaagtattctatcactggcattatttattaataggattgccagtatatagtaataatgaaaaacaggccaatctatagtctacacacaattcacccacttactgtctgcacctagggctaactgctcccaaggcccacctggagaagtcactgcctatagccatcttggaaatatttaataaaacttctgacaagaataaggccaaaaggacagtgtactgggttgaacagtgtccccccaaaattcatgtccacccaaaaatacaaccttatttggaaataaagtcttcgcaaatatatttagtttagttaaaatgaggtcatactgggccctaacccaatggctggtgtagttataagaaaaggaaacaagagacacacacaaggagaaagctatatgatggtggagacagagatcagagtgatgcatctacaagccaaggattgccagcaatgatgagaaactggaaggggcaaggaagaattctttcccagagccttcggaaggaacacagctctgccgacaccttgattttggactccagcctccaagactgtgagaaaataaattttaagatactcagtttatagtaatttgtaataatagacctagaaacctaatacagaaggagacacacttcataatctctgtgccctctcaatacaaaaatacaccttgattattcctaattccatatctttggctatgtacttttaaggtctttagagagccaagagtagcacttagaaaaaattccactagtattatgttggttttttgccctgtgcaatttgcaaagatgaagacaggaatttaagaaacaaagaacaaagtgacattaaaaaagaaaaaaaaaaactgaaaaagaaaaaaaaatcccaattgtttttctaattgtagtagccatggacaatcattcacctcctctggcttgggaactatgaaacacaagttttaattgattgtagagtacttattattacatctattttcctacaataatttaattggagaatcttgatcccaggagcaaacgtacacagcaacagccttctgctgcttttagcaaaacgataccttatacatagaatacttgagaaattcttataaaataaattaggtgtaagagaaatatcaactaattggtttcctgtttttccataaaggcaagccataataagcattcaaaaatatgtattagttcattaaaacacgttacctagtcaattcagtacaatcaattagtaggataaaaacactcagttaacctgggcagaaaatggcaaaaactgattggtcagattttttattccatttacccagagtatcctctaccattcccacttatacacaaaactttttcttttgttaaaaaatcaatttggtttcccaaactgataaagctaactctcccagactcacattctaaggtccctcaggcaatgatttatttggcagaatttatgatatcccaacatttattttttattttgttatttattaatgtttaaattgcctgttgatattttccctatattacctcccttcttgcttaaaccatttgccccaatgtcactcaacataagaaaattctcagtcatcaagatattctgccatgttcacaaagaaatgtagtcggccctttcctctctctcaagtgtctgcattcttttcatgattccatacatttctgctgtatgggctgcattcaaaatctgtaacttccccaggaccttttgtctgagtcagatatgctgctgtctcctgatatactcagttaaaaaaaaaaaaaatcctaaacacgtttctaagctcagtggaagaggagaggcatgaaacaaagatataaaactgaagcaagatggatttcaatgaggtatatttaaaacagaattatttttgcataaagcaagcccagggtaacaataaacaagagcaatagaggtgaaataaggaggggctggtgatgagaaaacagtgttcaatgtcctgtctgacacagtaccaagtgctggcgagcatgaggagcctaggcaagtctcatataaccactttggatggcagtttagcataatctacaaagctgaactcatgcatcctccataatcatgccattccactcccagcagacatgccgttgggggcatatgtgctccgagtgttatatcagtaatgttcacagcagcattacttggaatagccaaaactggcaactactcaaattgcaacagcaaaatgtgtagtataataaaattttatacaacttaaatagacaaacttacagttacacagaacaataaacagcagtccccccttatctgcaggggatacgctccaagacccccagtaggtgcctgaaactgcagatagtaccgaaccccatatatactatgactttttctgtctgataaaggagaaggctgctgagtgactaacaggtggataatgtatacagcaaggatatgctcaacaaagcgatgattcatgtcctggacaagacagggcaggacagcacgagatgccatcatgctacacagaacagtgagcaatttaaaactcatgaattgcttatttctggagttttccatttactattttcagaccacagttgaccatgggtaactgaaaccacagataaggaggcactactgtacctaaatgtcaaaaacataatgctgagccaaattagccacacactaaaaaatacatgctatatggttccatgtacataaaattcaaaaagagacaaaagtaacctagtgatggatgtcaggatagtggatcttcgggaaggaaacaggggtcattactggggaggctcgcagaagggaggggagagtttgaggtgtgaagtgctagtaattaatgttctgtttcttgaacatgttgacagttacctgagtgttcattttctcataattcattaagcttttcacttatggcttgtgtatttttctgtatgtgtcatatttcacaataaataaaaaataaaatgttgtttgaccaaaactccctagctttctttctcaggcttactttttcaccctaaaactccactgacaaaagtgtttgccagtcttatagaaagaaaatatactttaaatggtcctagagaccttcaaaattacctccatcctcaagctgcatcctttcctcccatgtgttatctttcaccactattacaacgaaaacagagccccccatcccaaagtgaatccatcctcttcttatctcctacctcccagagaccttgccctctcaactacctccctgctttctaactctttttagtctttccctcgctactggcccctttccatcaggattttgctgttgctttccattctcttaatggtatccttttctatgttgaaatcattgcaaacttgtaataaagttccaacaataatacaaagaactcctatatataatacaaagaatccagagacccccccattcaagttttcatcagttgccccaataacattatgacaaaaaagatcactgcactgcacccagttcgtacatagtctcttccactgtaggacagttcctcaatctttccttgacatttttgaagattatagtagattgaagactgaagactgaagactgaaggcccttgtgtcctttcaatgtgtcacattattattgagtacctccttacttcctggaacagcaagatatttcaggctccagctcgagaatcagtcatttctccaaagagccctgattgctttcagcacagagtggtattccaaatcaacatatgggtcctaaatctactcactgctactagagagccactcttcccaggcgctctgagaaaggattaggaaatgtgtgaaaagaactaggaaatgtgtgtgtgtgtgtgtgtgtctacccacacatacacatgcatttacaaagacatttatttctctgtctacacatactgaaaatcataacttcatactattagctccaatttgaatccactgtagctttccccccttctatgttgataccacctttctccattcatgaaaaggctggcttccaccacttcaatatatttacttatttgttcagttgcctatgtgaagccaatctgatcccaactggccaccattaccacctggtctaagcatagtttccaatcagacgctttcagaagagttgcctatattcaccgtctttacttccataccttgagtcattcctcaacccactacaatttgatttccatgctgatcaaggtgaccagtaatctccttgccaccaaatctaaagaatctttctcaattcttttctaacttgaactcccttgcagcattcaacactctgaacattctttgcttcttaaaacactctttccctctggtttctgtgactccccactcaaattggttttccctccacctcgtcaaccattccttcttagattcttctactggcttctccccaaaccccaaccttactaattatgactgcctggggttctgtcctagctcttttctctgtgccatccctgaggtatttcatccgctaccatggctacaattatctacattctgctaacttacacatctatatccttaacccacatgcaatccctaagcttaagatctatctaatgaaacacctatcaaatattattccttgggtgtctctcaatcaccccacacaaaacacatctaacactgaaataatttccacccaaccccttcccccaaaccttctcttctttctgagtaatgtaactcaatgaacagagttgccctgcctgttcagaggctgcctgttcagcagcccaaaccagcagctgaggaaccattcctaactccttcttttttcccacccccacatcatcaagcctgctgaggttatatcctaaatctctttcagatttatttcctcagcagttctgtagaccaaccaatcctcattttttgtctgaatcaccaccacagtcttctaactggtcccctactcttgccatccttccaatctgatctacacaatctttgtaaaatatgcatataatccttaccccctccttaaaatccttccaagaatcctggcagcactcaggacagtgcttcttccttcacgtggctcactaggccctgcaggactttgtcctagctacttttacaacaccatctcttgttcttcaacttcaaactcaaccacaactgcattgaaatttctttcacttctgcaaacacacaacatcctttctagtccttgggccttcacgttcttttccctccgcctctttgctacattacttggccaaattctacttatccctcaggacacaggctctgggaatcttcccagaatgcccctgctctgcacttccatggcactctctacatctctagagtgctaatatattccaatggctcatttaatgattgaacttcccaatcagatcattagttctactaaggtctcagagagaaacagaaacagtgtcttagtcacagctctatcaccagcacctagcaaaatagccaaaacacagtaggtgtgccctaagtatttactgaatgaatcagcctcaaaaaatagcaactctacggcagccacagccaaagagcacatttcacacacatgcattaactcaaggtgtggggcagttaaacatcctccttaaagcaaactcctgttgctgctcgattcaaaggctggcatctttatgtgtaatgaacaataatacagtcatattagcctgaatgtaaaagaattatttcccttagaaaaagacagaagttcctcttctttctctgtagtaagttggaatgactcattattttttacattttcatgaaaacaacacacaacaaactcactgtgtgagacagcacacatcctctcagccaagaggggtacgacaagagtgaatgctttggcccttaagacgggtccaggatgttctccctgtacataactctgtgcatgtgtgcgtgcgcgcgcacacacacacacacacacacaaacacacatacactctcttcccctctcacacacacatacacactctttctctctctcccctccccccttacacacacacacacacacacacacacacacattcacagtgtctcagaaaatacacagcatgattgaacaaaagaaaaacagaaaatgcactcctgaaggacatatctccatccttagcatgttgtctggcccacaggagaggaaataccaaatgtaagaggtgacaccagccaactgtaaacaccgaagctggtgtctgggagaggaggagatctttgaagagggttaataccatttctactaactatatgccatgactcttataagccagatccaagccatctcgttcttattgtccctattttacatattttgagattaagtaagtagcctatagctaataaataacaaagtgcagttctttccaattcctagtgctatatcctaaaatgggtaaaactgaaaaatcagaaaacaccagtagaagcaccttattcagaaaaatgaagaagaatgtcagaggaaataaataaaagttaaaaatggttggttctggggagtaggaagtaagaataggaagtgatgggcaagaggtcttatttttcatataaacttactagtaatatttgagttttaaaattacacatgtattattttgatataaggtacaattttaaatcatagcaggagactacttattgacaaaataatatctaaagtatgatccatttaaaaatataaggccgggcgcagtggctcacgcccgtaatcccagcactctgggaggccaaggcagtagatcacttgatatcaggaattcaagacctgcctggtcaacatggtgaaaccccatctctactaaaaatacaaaagttagctgggcgtggtggcgggtgcctgtaatcccatctacttgggaggctgaggcaggagaattgcttgaacccaggaggtggaggttgcagtgagccaagattgcaccattgcactccagcctgagtgacagagcaagactctgtctcaaaaaaaaaaaatatatatatatatatatatgtgtgtgtgtatatatatgtatgtatatatacacacacagagagagaagcttttgaatgctgttactaaagatgatctctgatgggtggggacacaagagttttgacggtttcttcttttcccatgaagatctgtattactatttttaaaagaaataaaattatttcacaaaatattttaaattacttacttaccttagctgatttttcaatatttaagcctccatccagttcaaaaagaacagtcatgttgtacccagtctggtttccatgtccatgaggccaccaagtttctacagtaatattcttttaagaaaatttaaaagtcactctaatatgtcatattttcagcaaaaaaggctcaaagcattacatcaatttctcaaatagtcaagtacaaaactctaggttctaaaacaatgtaagtctccccacctatattatgcccaatcagaccaattcattgataatatttaaaaatcagcatgctgggaatctagcatggatcaatacatcaaaagcaaaaggaaagaacagaataacatgagtgttcagaaaaacaactctccctatccctaacaccgagcttacatttattccacattcttaacacttaaaatgggactctgaagttgactcttctttcaagccaaaaactaaaaatcattttgagttcttactttatctcaacagctactgaatgttattttgctccacctttttcagtacacaattatcaattagaggaatagaaaaaagaaaaagaaaagataaaaataatccgttctaccttgatatatgaaagatcatgagtttagaattaaaattgtgcatgtagaataagtatcaataatcaaaataattgacaagtatcaaaaataaccactgctatttaaatataatccatagaatgtattttggctttaggatactacaaatactacagaaaattaaaatacaatgataaaaataaaatgagagaaagaattgccaaattaataatatattctctattttcttaatcttaaagtttgggaaaatcattctttagctcatactcacagaaaatatatgagagactaaaatagagaagaaaatgacaaatataagcagagaaagtagaattttctttcatacttagtccctcctttctaatcatttctttagcacaggtattgcttttcatccagtgcttctcaggaagtaccatcatttaccttgctaatgttcacaaatagctcaacaatccttttcccaggttgaagttcaatgctgtatgtctgttgtgtttgcaacttagggatggctacgatcacttgaccaccaactggctttgagctgacaacatcaaatgtagactctatttccagattccactcctgggcactcttatctaaaatataaaaagaaaaagaaatatatatatatatatataatatgctaagcattatcactgcatttctcaggattcattgaaggtaagactaaagcagcttcaaacccagtatgtgctccacaatgctgtcataatcaaaacttcgtggaaattttcttttaatcttcagtttaatccttcattctgaagaagaataacaaaaatggtatattttacatagacttccactctaaaaatgttatgattgtaagtcataaaaactttatggagcataaacagaaaatgacaaatggaaagataaaataaattttccaagaataatacacatttgttcctttttaattaagtaaaaatactttataaagtaaaaagtaatagtattttactttataatgtaaatgggttttaaagttatgtaataaggtataaatttatatgtattaaaattaatcaaatgtgaaaaaataaagttatactttaaatgtagataatttatccaataaatatttcctgaggactttctatgtgccatatactctgctaagtgatgggaattaaatggtgaccaggataaacatggcccctactctcatgaactaaaagtctatagacaaattcaaaagcataataatatcaggacaggagaaataaaaggttgtcctgagaaataaaaacaggacatcagaaagcacagctaatacagagagggtgaaggaaggctttctctcttttctttttcctttttttttttttttttgacacaggttctcactctgttgccccgggagtcacacaatcatagctcactgtagctttgaactcctgggctcaagcaatcctcctgcctcagccttctgagcagctggcactataggcatgtgccactcacctagctaattttctttttactttttgtaaagatgaggtctcactttgttgtccaggttagtcttgaactcctggcctcaagcaatcctccagcctctacctcccaaagcactgggattataggcatgagccaccatgcctggccaaggaatgctttcattagaaagtggtatctagctgagaccagaaggatgcctcagctaagtacagaggaagatgataaggattctgggcacagagaagcatgtgaaggcccatgagtgagacagcaatgccataacaaggaaaacaaggaacttgggcaataacaaaattgatgagggggtcagcataattgaaaagttgagcacggtccaaatgacactgggtcttttcgaacaggtaaggagtctggcaatttcaccccagatcaatgcggagtcattgaagatttttcatcaaagagcatgaccagatctgcattttataagaattgctaaaggtcccagcacagtgatatacaaggatgaatatgaaagaagcagaaagatataaaatctctctgtgtacaaaaagccccagaaaatgccacttggaaaagccaggaacagagaggaggcaaagaagagtgttgatcagaaagaagagaaaacaagaccgaagaggagaattatagggaaagaagaaagatgagggatgaactttgggtgcagagtttggggttgtcagaatgtttcgaagaggttttgaagtagagttttatatacgcgcagtatgactctgtcctccatttcctgtcaaatttatattgtttgtataatgtctccgggtttggttttgtgtttagtttttatttttaaacaagatagagcactgggacagacttgggacaagagctgggtggaaaaacagaccgttttttaaagttacgcagaagaaactggtcatgagatctcaaaaaagcttggaggtacagggggttagagtcagcaaaaaaagttctcattctttgctgccacagaaagaaaggagaagagcagtgactgtgcagaggcatttaagtttctatgattcgtggcaaagtatggagggagttcctatttagtggcttctatttttctccaaaggaaggggagggggaaggctactagctgagaagtatcttagagacctttctcctacaaataaagaagagattaataatcatggctttgctgcaaaagaaaaaaaaaaaagctaggtttctatgctgatcaatgacaaaagacgttataaccggcactgtttacaactgtaggagcacaccaggcctgttctaaagatgaccccagcacagtttatcattcgcatctcccatcagccaaaagcatagatttgatgcacattgaagtaaaattaatcctggacttaagaactatttttgtttattaagtgatttattctgagaaatactagtcgatgagctctgagttaggtttgttctgatccagttaattttgcaggttacttaccgatagcctccaggttttgaatctatcagctggtagatcacctagtctgctcgctcaccagtgtttaatttcctctattcaataggttgtcaaactatggtctttgggacaaatctagcccacctcttgtttttataaataaacttttattggaacacagatgttatggactaaatggtggactcttcccctaaaattcttatgttgaagccctaacctccagctttttatgaagtaataagggtggggcagtaatctgttaggattgcagccttataagaagaggaagaaacagatatccgtctctctctctactatgtgaggacatagcaagaaggcatctgtctgcaagccaggaaacgagccctcactggaaaccaaatgggccaacacctttatctcggacttcccagctgccagaactacgagaaataaacttctgttatttaagccactctgcctatggtattttcttagggcagccagagcagactaacttaatagtcatgctcatttgtttacttattgtctttggttacctttgcaatacaacagtagagttgagtagttgtgacagatgcctaaactattttactatgtgatccttaagagaaaaagtttgctaatccctgccctagaatattacccccaaaaaaggccattccaacctttctttaaatatctctaatgacaaaaaaacctctgcctcacaaaatagccttcccatttttgccaggcttggctattgtaaagactccctttacactgaatttgaaatatacttctccttaatatccaactaaagattttagctctgtcctttgagcacctcctaccaacgaagcaggctcctgtgttgttttctgttacttcttctttagtaggagaatcagctgttagtgacagcctctgacaggaaaacaaataatgcaatcctcaaaggtcatcggcaaaattccccagtttctcttgctttgaacttggaaggttctcgagcaagtccgcactcctccagagcatcacccgttaacacccctgggaactactaaatgaaaaaactaaggttgtagaattaaaaacacagtatgaagatctacaagcctacaaagttatcaccagatatacttaataacatatttttcccctctcctcttctttcaaatagagtaaaccccttccttccagtagcacatggaaaagtaggtaatttaggttcacaaggcgcaaagtcttaaataaccagtagttttcctgatgttctttggtcactccttttcacttgctaaattaaatttataaattgcataatcctatttgtagttaagaagaactccatcttataaattaagccccatttctagaatacagcttcctatcatctctctcctagcattaataagtcaccatgtcttgaagaacacttatcatcaccagctctcctgaagtaaaatgcaagatcacttcaaaaatggatgaagtactgggggtgagggcaggaaagaaggattgctacatcttctagaatcccctacagagctcatccttccaatcacaccaccaagttctgcatcctctcttcactttgactaaacaactcagcacaaagaggacaggaattctttatcaaaacaggtgcaaaggcaatgctggcctgccctctccacaattcaaggccttgaggccctccctggcctgaaggcttattggtgtcctcgctgatgtcctaagcccaagcagaagagattatgttctacagtttgttcatataacctcaatcaggaaggcaacccagaggatggtagagaatgtggttctggccactaattcgctttaaggttttcccagagatgactcagtgagtgttctttaaaaaaagaaaaaaacaaagagcacaatgtgtctgacctggatgggaatttgtagaaaggtaaacagctacatagcctagattaatgtatactgctccttcgttcagagtatcacaagacaactctagctcatgtagatgtgtccagtacatcagccttcaaaatcttctcaaatacgccagcttcctcttatattctcatacagtctactcctttattaagatgtagttggaggggggacaaaaagccaaaaaaaaagaaaaaaagctttattcaattgtctaggagaaaaaggtataaggagagatatagaaagtagaaaaataagaggactcagttacattacttcaagtttgtcaaaaagtaacaggaagacatactcccaaactatacactgaaccttgctttaattgattgtaataaagactcaagtatcaatgttttcatctagtcatgtgatgtctagtttcaagaaaaactgggttgttccatacttataccctcattgggtggtaatgactattctaacttacaaacaaaggaaaagaaccacaaaatgttcgaggtagaagaaacttggagatgttctcatcactttgcagatgtttctgaggccctgactgcagcacttccctcttgagccagtggacaggccaagggtccaggtttcctaactctggtgctctcgactttccatgagcctctcgcagcgatgcctaccaaaaggaatgacactcacaggtacacaacgattgacatttgtatatgaataatgaggaaaagcaaaagcaaaggtactttttgcctttcagagtcctaaagccaaatgtcgaatatattcaatgtaaaacaaagcattctgggggcactgtaataataaaatgttagcctaagagggtctctgtaaaaaaagaatactgaaatgggcagggtgtagtggctcgtgcctatagtcccagcactttggtaggctgaggcaggaggatctcttgagcccaggtgtttgagaccagcctgggctacataatgagaccccatctctaaaaataattttaaaattagctgggtgtggtggcacgcctgtggtcccagctacttcagtggctgagatgagaggatcgcttgagcccaggaggtcaaggctaatgtgagctgagattgctccactacactccagcctgtgcaacagcatgagactttgtctcaaagtaaaaaaagaaaggacactgaaatctacaaacatagagaatatgtctgaccctctgctaaacgtgtatttatatgatgccacagttcctgtacttatcaaaatactgtctttgtaacctaaactagctgaaaaggcactaaaatagttatgtgagcatttgtgtcaagcaaatgaaatctatttcttgaataactactgtctgtaaaaccttgacaggcattataaattatatcccaatccaaaaaggcaaatatgttgtctctaactctctgaacatatttagaaagataaaatatacccaagtgtcgcagttaagaatacaggatggcatcaggaaccataaggactagcagggcagtgaaagttcagaggcagggcacattcaagtcagcaagggatgaatctgcaaacactggtagatgaaaaagatgcttcatctcactggggggaaaacctattcaaagatagctgcctggattagctttgccctgctgagctcctcacagctcccccttttgcaggctctcttcttcctccatctttaatagagtatgaaaagctgcagggaaaggtagttatgtgcatttaaagaaacagcaatgacaccaaatgaaatgaacaagccatggaatttataaattcaaacattagatattttccggtactcctgccagaatcatgggacagacttaagcagctgcttttcaaagagctaaccattgcgttagccaaaaatgttggcccacagttagttaaaacagctgttttccctcttcttcaccaagcagcaagatctccttacctactcagcagtacaaaatccttgaaactgaaatcaaggcaaaagagacgcaaggcaaaatgtttcctagaacaaggataagttagtaagctccaaagaagaaaatttactcaagcaatgaggagactaatcacaggaaaaattattcaagcaacctaccctctctatgggtatttcaagcaaaatacccataaagttattttcaaggattattttatggaaaaaataatttaaagatgaatgaaaaattgattccaaatgaatgcattaaaaaatgcatgcttatcaaataagcaagactgacaaatctttattttattttatttttttattattattatactttaagttttagggtacatgtgcacaatgtgcaggttagttacatatgtatacatgtgccatgctggtgcgctgcacccactaaacttgtcatctatcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacctgtgcatgtgtctttagagcagcatgatttatagtcctttggatatataccctgtaatgggatggctgggtcaaatggtatttctagttctagatccctgaggaatcgccacactgacttccacaatggttgaactagtttacagtcccaccaacagtgtaaaagtgttcctatttctccacaacctctccagcacctgttgtttcctgactttttaatgattgccattctaactggtgtgagatggtatctcattgtggttttgatttgcatttctctgatggccagtgatgatgagcattttttcatgttttttggctgcataaatgacttcttttgagaagtgtctgttcatgtcctttgcccactttttgatggggttgtttgtctttttcttgtaaatttgtttgagttcattgtagattctggatattagccctttgtcagacgagtaggttgtgaaaattttctcccattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattgaatagggaatcctttccccattgcttgtttttctcaggtttgtcaaagatcagatagttgtagatatacagcgttatttctgagggctctattctgttcccttgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaggaaagtcattggtagcttgatggggatggcattgaatctataaattaccttgggcagtatggccattttcacaatattgattcttcctacccatgagtatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggccctctgtttgtctgttattggtgtataagaatgcttgtgatttatatacattgattttgtatcctgagactttgctgacgttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggaatggtgagagatggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctatagagataatcatgtggtttttgtctttggttctgtttatatgatgtattacattgattgatttgcatatattgaaccagccttgcatcccagggatgaagcccacttgatcatggtggataagctttttgatgtgctgctggatccggtttgccagtattttattgaggatttttgcatcaatgttcatgaaggatatgggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcagctgtaaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctaacggtctatcaattttgttgatcctttcaaaaaaccagctcctggattcattaattttttgaagggttttttgtgtctctatttccttcagttctgctctgattttagttatttcttgccttctgctagctttcgaatgtgtttgctcttgcttttctaattcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaaaaacatctttatttctgccttcatttcgttatgtacccagtagtcattctggagcaggttgttcagtttccatgtagttgagcggttttgagtgagtttcttaattctgagttctagtttgattgcgctgtggtctgagagatagtttgttataatttatgttcttctacatttgctgaggagtgctttacttccaactatgtggtcaattttggaataggtgtgatgtggtgctgaaaaaaatgtatattctgttgatatagggtagagagttctgtagatgtctattaggtccgcttggtgcagagctgagttcaattcctgggtatccttgttaactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgtggaatttatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgggagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctcgttagttgatgcagtttcttcctagtctccatggtctttacattttggcatgattttgtagcagctggtaccggttgttcctttccatgttgagtgcttccttcaggagctcttttagggcaggcctggtggtgacaaaatctctcagcatttgcttgtctgtaaaggattttatttctcctacacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggcaaagttctcctggataatatcctgcagagtgttttccaacttggttccattctccccgtcactttcaggtacaccagtcagacgtagatttggtcttttcacatagtcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcgagccttggttttcagctccatcagctcctttaagcacttctctgtattggttattctagttatacattcgtctaaattcttttcaaagtttttaacttctttgcctttggtttgaatttcctcctgtagctcgtagtttgatcgcctgaagccttcttctctcaacttgtcaaagtcattctccgtccagctttgttccattactggtgaggagctgcgttcctttggaggaggagaggtgctctgctttttagagtttccagtttttctgctctgttttttcccaatctttgcggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtagaaaccactatttttaaggactaagaatacagaaaagaaacatagatatatacatatatataagtaaatgaattcacaagaatttcacgttaatttttaaatgtttaatagccttctttctgtcatacacaagttagggaactatggttggtcctttgatcttcaggagtaaactcactaattttaagtcaagatataaattgaacacttgaaaaagcacaaagatgacagtatctctttctagcctcaacagggggaaggcagaaagtgtcccatagacaaattagtttaggctttcatatcaagttagctgaagttactagactaaattagtttgttttaataactactttatccacttactgcatatacatatatataacagatgcccaatatagaaatttagaaaagacagttacacagaagaataaaatgcaaaccatttttaacactactacagagatagctactgtttgcattagttgttgtttgtttacttgtttgtttgtttttgagacagggtcttgctttgtcacccaggccagaatacagtggaataatcatagctcgctgcagccttgacctcccaggctcaagtaatcctcctgaaactgcctttgcaaagttataactgaggaaattatgacaatgaaagaaatcagacctaatctactccatcttgcttgtaacatttaagctgttcttattcattcctggcagtaggctgaactaactttgggaaggaattcagttcatggtttgactctgaaacaaaatggatagcagccctttcccgaaaagaccccttcttgcctggggacgagtctgcctttgcaggactaacaaattagctacaagattagaaattacagtttaggggtcatgcaacctctggctccaagagtctgaacctccccaaattgctcctggggataacatcactattgtaaaacctagatcagtgcttgagatattctgcagaccctgcactggatggatcagctgacaccacccagactggtaatctggctcaaccagttctgccatcccactcaggaaagaagacagcaagaaaaccttacttcgttccccctatgattccatctccaacctgatcaatcagcactccccactttgcaagcccctacccaccagattatctttaaaaactctgatcccacccagcatggtggctcacgcctgtaatcccagcactctgggaggctgaggcgggtggatcacaaggtcaggagatcaagaccatccccactaacacagtgaaaccccatctctaccaaaaatacaaaaaataagccaggcgtggtgtcgaacacctgtagtaccagctactcgggaggctaaggcaggagaatcacttgaacctgggaggcggaggttgcagtgagccaagatcgcgccactgcactccagcctgggtaacagagcaaaactctatctcgaaaaaaaaaaaccaaaaaatttgatcccaaatgctgaacgtctggggagactgatttgagtaataataaaactctggtttctcacacagccagctctgcctgaattactctttctccgttgcaattcccctgtcttgataaatcagctctgtctaggcagcaggcaaggtgaatttattgggcggttataatcccacctcagcctccgaatacttgggactacaggcatataccaccacacatggctaattttttttattttttgtagagacaatgtctgctcaggctggttcaaacttctggcctcaagtgatcctttgaacttggtctcccaaagtgctaaagattacaagcatgagccaccacgcccagccttgcattagttttgacccacctcatttcacacttaaattttaaaaatgaatacattttattttaaataaaaattatatgtacctttttttattatgaactaagcttttttaaaaattttcagtaactctcacagtgcctgcctcatagtatataccaaataaatacataaaagtatccagaccacattagcttattcttttattatttttcaatgtttaaacgtctattgatatcagtgataactgctgtcttccagataaaaattgaaaaaaaaaattctggagaaactcctaaaggtagaactcttttaatgctctcatgagcttacactctaattttattacatcaaacaaccaaattgataactataaaattaattagaaatataggaattactgcttaacatgcacaaagcacatcttcttaacaggaaacatatatttctctatgttaagtacaaaatatattactgtcataatatttcaaaaatgagggaggagcttcaagatggctgactagcggcatctggtatttgccacctccacaaagaagaaccccttcagatagatcacctatcaaaaaacactgaaattcaacagagaagtgacagaaaacacctaaggtaaggaaggagagaaaaggaaggaaccctgcttagcagggaccagctgaaagcctggagaggctccccaatgctgggagaaggtaagtgagtggcctccagtggtctacattcccattatggactcctgcaatcctagccatgagagagcacctccaccctcgcagcccccaggactagtatagggagctacaagatatgcaatggcattgctccagagagggagctcctaagcggttaaagcaaggcaccattttgagagtctagccccgaatggactgcaggctgactttgggcttaatagcccctacatctccacattcctggagacttactgacatccccaagtgtagccaggcactgctgctggctgctgccaccaatgctgaagcaactccaccccctcaggagcagggctgctgcacatttcaaaacaccctgtggaagggctaccctgcttatctccactacctggagcgaaagtgcatgctctccagtcacctatagctactgccactgaaagcaaccccatcctccccaggagcagggcagcagcacagtcactactgcccccacccaagcattccaccagtggtctggatatcatcccatgcctgcctaccacagccagctcccacatgcaccactagaggggtctgaggacaggcctgccctggctctacactcccactcagtgcctgagcaaatggtctggaagcctggggatgaccctgccccatccaccactgttggtacctcagcactcctcccaggagcctgaggacaggcccactaaacctgcagctactaccacagctaacatctgcctgcatgtgccacctacgggcctggggactagtgtgcccagcctgttgcagccactgtcaacaccaatgcagacttcttggaaaccagaggattgtcctgccactgctactgccatttcccatgccatacctgctgtccaggggcctgaagacccagccatccagaccagtggtctaccactgccactgccagcacccaagcaggccagtcacctggaggcccaagattcatcatgcttggactcactaacaccagtgccagcatatactgcactgaagcccaaggacaggcacactcagcctgctgctgccaccagtgaagtccaaggactggccttcttgatgaccccatccccagcaaaacttcactacagcctccactaacaactataccctaagccactgaggaaatcacaaacaccactgatgctgtttacagctgaagaaatcaaacagaaactatactattgcaagcactcaaaatcaaagcaaaagtgccctacccaaacaataccacagatacatcttcaggaaaaattcctcccctataaaagagaattcaaaaaaattagaagaagtggttgttataccagatgcgtggatataaacatgaggacacaagaaacatgcaaaagcaaggaaatatgacactttcaaaggaacacaataattatccaacaacagattccaataaaatgtatgaaatcccatataaagaattcaaaataaggaaattaaagacattcattgagatgcaagataactcagaaaaaaaaagaaatcagaaaaacaattcagagtatcaataagaaatttacaaaacagacagatataataaaaaagaaccaaacataaattctggaactgaagaatctagttattcaacaataactagagaaagcagaagaaagaatttcagaacttgaggacagatttttggaagtaaaccagtcaaacaaaacttttttaaaagaataaaaaagattgacaaaagactacatgacatatggaataccataaagtgactaaatattctaattttcagtgtgccagaaagcaaacagaaaattacaaagagagaaaacctatttaacaaaataatagctgaaaacttcccaagtctggcaagagatttaatatctagataaaaaaatctcagagattcccaaacagatccattcaataaggccttctccatggcacattacagtcaaactgtcaaaagtcaaagacaaagagagaattctaaaatcagcaagagaaaagcacctagttacttataaggaaaccctcatcacactaacagcagatcagatttttcagcaaaaacgtcacaggccaggaaaaaatggaatgatatattcaaagtgttgaaagagaacagctcccagccaaggatgccatacccagcaaatttatccttcataaataaaggacaaatcatctttctaagacaagcaaaagctgagggaattcatcaccactagaccagacctacaagaaatggttaagggagttctacatatggaagcaaaaggacaatatctaccatcatgaagatacataaaagcataaaaccactggttgagtaaacacaaatgaggatcataaaggacccaaatgttaacactacagaaaaacaccaaaccacagtgataaacaataatagaaacaaaaaaaggtatacaaaacaaccagaagtcaattaataaaatgacaggaataagccctcatatatcaataataaccttgagggtaaatgaattaaactttccacttaaaagatataaattgactgacaggattttttaaaaacatgaccaaactatatgctgcctacaagtagctcaactcacccctaaagacatacatggactgaaagtaaaggaatggaaaaatatattccatgcaaatggaaataaaaatgagcaggcatagctatatcaacatcaaataaaacaaagtttaagtcaaaaaacagtaaaaacagacaaaaaaggtcactatatcatgataaaatgatcaaatccacaagagaatataataattctacatatatctgcacccaacttggagaacccagattcatgaagcaaatattaccaaatctaaagacagatagattccaatacaataatagtgggggatttcaacatcttactctcagcattacacagatcatctagacaaaaaattaacaaagaaacactgtatttaagctgtactttagaccaaatgaaactaatacacatttaaaaaatatattatagctacaaaatgcacattcttctcattagcacatagcatattctcaagaatagataatatgttaggcaaaaaaatgactcaacaagtttttaaaaattaaaatcatatcaagtatcttttcagaccacaacggaataaaactagaaatcaataacaagaggaactttgaaacctgcacaagcacatggaaattaaacaacatgctctgaaatgacaattgggtcaagaaagaaattaaggaggtaataaaaaaagtcttgaaacagataaaaattgaagcacaacatattaaaacctatggaatacagcaaaagcagtgctaagagggaagtttatagcaacagatacttacatccaaaaagtagaaagatttcaaataaacaacctaacaatgctcctcaaggaactagaaaaacaagaacaaactcaatccaaaattagaagaagaaaagtgataataatgatcagagcagaactcaatgaaatagagacaaaaaaaacagcaaaggatcaatgaaatgaaaagtttgttttttgaaaacaagattgataaacccctatgtagactaatcaaggagaagacccaaataaacaaaatcagaaagttgtactttagaccaaatgaacctaatacacgtttacaaaatatactaatattttgtatattattatatacaaaatatatatatgagaaatgagaaaggatacattacaactgatactacagaaacacaacagatcaccagagactattatgaacgactatacgctaacaaactgaaaaacatagagaaaataggtaaattcctggacacatacaacctgccaatactgactgacaaaaaaatagaggccaggcgcagtggctcatgtaattccaacactttgggaggccaaggcaggaggattgcttgagaacaggagttggaaaccagcctgggcaacatagcaaggccccgtcaggaaggaaaggaaaagaaaggaaaggagggagagagggaggaaaaaggaaaaggcaaggcaaggcagaaaaggaaaggaaaggaaaaaagaaaggaagaaagaaagaaagagagagagagaaagaaaagaaagaaaggaaggaaggaaggaaggaagaaaagaaaagaaaaagaaaggaaggaaggaaggaaggaaggaagaaaagaaaagaaaaagaaaggaaggaaggaagaaagaaagaaagaaaaaaaagaaagaaagaaagagaaagagagagagagaaaggaaggaaggaaggaaggaaatagtgaacctgaacgactaataataagtagcaagactgaatcagcaataaaatcttccaacagaaaaaaatccaggactggatgccttcactgccaaattttaccaaagttacaacgaagaactaataccaattccacacaaactattccaaaaattgaagaggagataattctctctaactcattctagaggtcagcatcacgctcatatcaaaaccacacagagaggcaacaagaaataaataaaaggaaagaaaagaaaactatagctcattatccctgattagcatggatccaaagatcctcaacaaaatcctagcaaaccaactccaacagtatatcaaaaagataatataccatgagcaagcagaatttatcccagggatgcaaggatcttacatttgtacaaatcaataaacgtgatacatcacatcaacagaatgaaagacagaaaacagatgatcatctcaacagatgcagaaaaagcatttaataaaattcaatatcccttcatgataaaaactatcaacaaattagtcatagaaggagcatacctcaacataataaaagccatatataaaaacccagagctaacatcacaccaaatgaggaggagctgaaagtctttcctctaagaactagaatgggaaaaagatgcccacgttcaccactcctatccaataaaatgctggaagtcctatccagggcaataaagcaagagaaaaacataaaaggtaccaaattggaaaagaggaagtaaaattattcctctttgcagatgacatgctcttacatctgcaaaaacttggaagattcataaaaaaattctaggtccgataaataaattcagcaaatttgtaggacacaaagtcaacatacaaaaattagtagtgtttctacacatcaatgatgaactagctgagaaagaaatcaagaaggcaatcccatttacaatagctacaaaaaataaaatacctaggaataaatgtaaccaaaaaggtgaaagacctctacaaggaaaactataaacgtctgatgaaataaattgaagaggtcacacaaacaaatcgaaaaacatcccatgctcatgggttggaagaattaatatcattaaaatgaccaccatactacccaaagcaatctacagagtcaatgcaatcactatcaaaataccaaagtcactttgtacagaaatagaaaaaaaatcctacagttcatatggaaccaaaaaagagctcaaacaaccaaagcaatcctgagtcaaaagaaggcatcacactacctgaaaacagacacataaaccaaaggaacagagtgtaaaccccagaaataaaccaacttattaataactaactgatttttcacaaaggcatcttggtcagagaacatgcattggagaaagaataccctcttcaatcctcttcaataaatggtgcggggaaaattggatatccataagcagaaaaatgaaactggactcttatctctcaccataaataaaaataaactcaagatggattaaagacttaaacataagacctgaaacgataaaactactagaagaaaacatacgagaagcatttcaagacatcgatctagacaaagatttttatagctaagacctcaaaagcaaagataacaaacataaacatagacaaatagtactatattaaactaaaaagcttcttcacagcaaaggaagcattcaacagaatgtagagacaacttgttgaatgggagaaaatatttgcagactattcatttgacaaggtactaatatctggaatacacaaggaactcaactgaacagtaaaaaagcaaataaccccatttaaaagtgggcaaaggacatgaatagacatttctctaaagaagacatacaaatggccaacaggtatatgcacaaatggtcaacatcactaatcatcagggaactgtaaatcaaaaccacaaatactatcttactccagttagaatgactattactgaaaagacaaaaaataatagatgctggagaggatgcagagaagaggaaacatttatacacggttgtgggaatatgagtgagtacagccacaatggaaatactatatttctcaagaaactaatagtagagtcattaccatacaatccaagaatcccactaataggtaactatccacagaaaaagaaatcagtataacaaaaagatacttgcaccccatgtttactgcagcactattcacaatagcaaagatatagaatcaacctaagtgtccatcaacagatgaatggctaaaaaagaataaaatcatgtcttccacagcaacatggatggaactggaggtcattatgttaagtgaaattagatagagaaagacaaattttgcatcttgccactcacatgtcagaggtaaaaatgttgatctcatggaggtagagagtgaaataatagagacgagaggctaggaggggtatatgagtggcagagaggaatgaagaaaggctgatgaatgggtacaagcatgcatttaaatagaaggaataagttctaatgtttgacagcataatagtgtgactatacttaacaacatgtatggtatatttcaaaatagctagaagagaggacttgaaatattcccaacatagagaaatgataaatactagaggtgatagatacccgaattaccttgacttgatcattacacattctatgcatgtaacaaaataccacacataccccataaatatgtacaaatattacgtgtcaatttaaaaaatgtatttaaccttcaccaatgtagttgagaggaggaactgtttacactgaatctaaattgaattttaagcatcatttaaattaattcatataaaattcactcagtcactagtgactaataaagtgaactctaataactcaggaagaaatgtttagtttcatattcaaattgtaaattaaaccagagcagtattattcaaatttttttcaggcatcagggtacccagagcttataatgcattttgcagaccacccaaaatactgattaagcttcaaaataaataaataactttttgctaaatcggaccactttttttttttttttttaacagcatctcgctccatcacccaggctggagtgcagtggtacaatcacaactcacagcagctctacctcctgagctcaagcgatcctgccacctcagcctctcgagtagctgggactacaggtgaacgccaccaggcctggctaatttttgtattttttgtattttttgtcagagataggattttgccatgttgtccaggtcggtctctaactcttaggctcagggaatccacccactttggcctcccaaagtgctggaattacaggcatgagccactgcgctcagctcagaccacttctcacaccagattctgttatttatacctgagaaaacgtatgggtggtagcatgggatgaagggagattaaaccattatttgattttagtagcgaaaatctttagttggattacacctcagaagaatagtttgggaagcactaaactagagaattataagcacagccacatttacatgtgcaatttaaattagatcttttaatgcctttttaaagtttaaaaatatcaacagcaccaaataacctcctcaaatctaagcatctatcatttgctttcatcttctgccttcagaaaatacagatttggctcaattgaatagcaagctaaggtcaccagggctctcaagataacagaactcttgaactgacacaccacattctttcttactgatttcatctagttaggcctccgtgtgattacactgagcattgcacgctctcatttaagatctcacttgcctccatcttcatccttcatttccctaacttctcaaatcctcactgatctttgattttctggctcttatcttggaaggttatttgttttgtttggtaattgtttgtatctcccctccccacacatgaagggatcagtgtacctactctatttcttttatcaaataaacacagcgctgagcaaagaaagcaacaaatatttaaccagcttttaacttatccactgacatctgtgagatttctgaggttctatttcaatgctccttgatattgaatagttgcttcaacttaaaaagtactatttttcaccttagaaatatttcttttggccaggcgcagtggcttacgcctgtaatcccagcactttgggaggctgaggcgggcagatcacctgaggtcaggagttcgagactggccaatatggagaaaccccatctctactaaaaatacaaaattagctgggcgtggtggcacatgcctgtaatcacagctactcaggaggctgaggcaggagaatcgcttgaacccgggaggcagaggctgcagtgagccaagattgtgccactgcactccaggctgggcaacaagagtgaaactccatctcaaaaaaaaaaaaaaaaaaagaaaagaaaagaaatctttcttttgccctgtttaccttccagtttatttttaactcttcacaaggctgttgtgtcagggcccttgtgtcagggccctcagagtagtgctccgggttatgaagaaaatgtacagagacagaaagccagtctaacggtgtgagcaaagcaagaatttgacactaaaagtgactacagaggcagcaaaaaggagcacagccagcaggcccagttctttcaagaaagaatacttatctcaggaaaacttggcgctgctcttccattttattttttcctttttctgtaaaatatgctaaaagatacctacctacatatctgctttatattgtcaattttcatgtaaaatcagtttgtacctattttttacttttataaattgattgtaccacaaagtttttaaaaattctaaatctctgaaaaacatacctctgtatttcaattataaacccaatttttataacaagaagactcaaaaagaaaaaaaaatcacatctttcagcttaccatatattggggaaaatgtgaagtagttcaggtgacaaatattataggcttcaattctaacatctttccagattccctgggtaggaaaggaaggcccccagtcccaactaaaggaacattgctcctgcaatttcaaggagaaaaagaagatatattctgattatggtgaaatttaaacattatgaaaaacattttctttaaaaatgttacatatgtgtatataagtttgctatggcagccataacaaagtatcacaaactaagtggtttaaacaatggaaatgtattttctcacagtgaagtccaagatcaagctatcagcaggtttggttcctcctgaagccgatctcctctgtttgcactgtgtcctcacatggtctttttctgtgctaggcatccctggtgtctctctccattgtccaaatgtccccttcttaaaaggacactagttgtattggaatagggcccacactaactgcctcattttatcttaatcaccccttaaagaccttctccaaatatgattacattctgagataccagaggttaggacttcaacatatgaatttggggggaccacaagttagtgcaaaactgtgtgtgccccccaaccaccatacacagcctctgaggtggcccacaatgatcccccctttgaagtgacctagtgaatcacttctaaccaccagcatatagcaaaaatgatgtgattttattaattaggttataagagactaagccttgaattttgggtactctctcatgccctctcttggccaagagggaagccagcctctgtgtcatggggcagctctgcggagagacccatatgggcaatctgaggtctgccaataactacaagtgagctcagaaacagactcttcagccttgagtcaacttgagccaagccttgagacaactgcagccatgagaccttaagccagaggcacccagctgagccacactcaactcagattcctaactaacagaagctatcataataaatgttttgtttatattattttttagaaatcagaaaacctatagtccacatattttctttttttaacttttaagttcaggggtacaagtgcaggtttgttatataggtaaacttgtgtcatgggggtttgtcatagagattatttcatcatccagctattaagcctagtacccattagttatttttcctgatcttctctctcctcccaccctccaccttctggcaggccccagggtgtgttgttcccctctatgtgtccatgtgttctcatcaataaatgttgttttaagctgataagttttggcataatttgttacatcacaatagataactgatacaatatccaatatatccaatatatctatgttgcacgtaacctatgaaacagataaatttggcagaaatgttctaagaacataaaatctatgaagagttgtacatttattcttcaaatgcttactacattgaagcaactcaatagttcctctttaaatttctctataatatctctgaacctaaccattgtatttaaatctaatagttacaaagaatattgtgcttacatgtaataattaaaaagaatgaggaggccgggcgcagtggctcacgcatgtaatatcaacactttgggaggccgaggcgggtggatcatctgaggttgggagttcaaggccagcctgaccaacatggagaaaccccgtctctactaaaaatacaaaattagttgggtgtggtggtatatgcctgtaatcccagctactcaagaggctcaggcaggagaatcgcttgaacccgggaggcggaggttatagtgagttgagatcgcaccactgcactccagcctgggcaacaagagtgaaactcagtctcaaaaaaaaaaaaaaaaaaaaaaaaagaatgaggaaacatattgaaagacaaacacttataaataggttttaaaaagctctggctaaacttgccaacctcaggtatgaattcagaagtccttgtttctgaacgtgaagcccaaaagcaatcagttcgatctttagcccctgaaacaggtggccaaggcagacattttatccaatcttatttgacctgggtacctgtctctcccttgatgacactcaacttccatattaagttacagagttcaaattcaaaaataagaaataattctgtaaaataaatccctttcacacagaatgttttctaatttctacttcttaaaagaaaaaaatattttcagaacagttaattaaaatgtgtaaagctataagttcagcttttaaaaaggaataagtttgggtcatacattttatggggggaaaaaaagtaacaagcaccagaggaaatactaaaatccttctagatggagtcatttgtgaaatagaacctgaagatttggccaaactgttgtcatttgggtattatttccttagctctgtactcacctaagatagagacaaatttgtttttactatggagaaaaacaaagaactaaagttactttatagcatccacatctgtctaaatttaccacttaagcaccagattctcatattcagaatgaaaaccatcttggggacatttatgggagaattttagtatctatttgtaattttttcattggagatagggaaaagaaggagagcaaaataatcaacatcttatgagggagactattttccccattaagagctacaaatcactcttaacctcttcaagaagtatttattaagtgccttctatgtttcaggctgggagtacttcaatatacacaacagacacagctcttctgcttataatgctcacagtcaagcacgaaattcaagcattgaataaataattacaagtataatgagttttacaatggaaataggcagggaacatacagtgagaggttgaggaggatgggtatcaagatgagttttcctgaaaaaaaaaaaaaagaccctgaagggtgagtaccgtttatccactgtgagcaggcaggaactttttttttttttttttgagatgtctcactctgtcacccaggctggagtatagtgacacaatcttggctcactgcagcctcaacctccaggctcctcccacctcagcctcctgagtggcagggactacaggctaatttttgtatttttttttagacttggggttttgtcatgttgtccaagctgatcttaagctcctgaactcaagtgatccacctgccttggcctgccaaagtgctgggattacagtcatgagtcactgtgccggcccagaagcattcctttcagaaggaacagcatgtgcaaaggtctggaggtgcaggacagtctgatgcattccagaagctgaagagagaacaatgggaagaggcagggagatgactggagaagtgagcatgggccagacagagctaagacccatggacactggcctaaaggcaatgagaagctgttgaagagtttgaagaaaagcagtgctgtgatcatttttttctgaaaagaccattctagctgctctgtaaatgattaactagaggaaggcaagtgaagtttcagggatgccagttaggcaaccagggcaatatttcatgcaaggcatgactgaactcaagacacagtggcagaaatgaaatgtgaacagactgaagagctattgaagaggtactattcacatcatcaagaggactaagcaatagattggaagagagaaaaaggagagaaaggtgtcaagaaaaactcaagtttctggcttgagcacctgttgtggatagtattccattcagcaagagacagaaccctgggagaaggacttaaatcacaagtgcggtgtggcgcatactgagctttaggtccctgtgaatcagacaagtgatgatgctaaataagcatctgaatgtaaggtctggaattgaagacaagttggacggaagacacaatattgggagacaatggcaaatagatttgttatggaagaaatgaaaaatgagatagcctagagagggtataaaatgagaaaagagtctagaacagagaaaggccctataatataacttttaggagaacaaggatgtggataaagagacttacaaggaacggccagagatgtaaacggaaaacaaggaagatggcatcaaacactggtaagagggtagcagaagtgatgagtcccactatccattctggacagaaaaggaagcagagacaataggggacttaggttgctacagggaaagtggaggttcaaagaactggtgaaagagaatatcaggggaaccagcccccaatatttcaacataggttcttttctattttccctaagtgtcagccagtctgagaaataaacagaaagagtacaaagagagaaattttacagctgggcctctggggatgacatcacatattggtaggaccgtgatgacgaccccaagccacaaaaccagcaagtttttattagggattttaacaggggagggggtgtacaaacagggagtaagtcacaaagatcacatgcttcaaagggcaataaagatcacaaggcaaggcaaaattagaattactgatgacggtctatgtcccgctgtgcaaacattgtcttgataagcatcttaacaggaaacagggttcgagagcagagaatcagtctgactagaatttaccaggctggaatttcccaatcctagtaagcctgagggtactgcaggagaccagggtgtatttcagtccttatctcaaccgcataagacagacactcccagggtggccgtctacagacctacccccaggaatgcattccttccccagggttactccttgctgggaaaagaattcagcgatatttctcctacttgcacatccgtttataggctttctgcaagaagataaatatggctctattctgcctgaccccacaggcagtcagatgttatggttatcttcccttcttccctgaaaatcgccgttattctgttctttttcagggtgcactgatcatattgttcaaacacacattttacaatcagatttcatattgttcaaacacacatgttctacaatcaatttgtacaatagtggtcctgaggtgatgtacagtctcagtttatgaagataacaggattaagagattaaagtaaagaccccactaacttcatataacctaagctgagcatcttgttcattacccgtaattatagtaataagcctccaaaatagatatcaccactctactttttgaatggttgtatagcactttacaacatgcaaagtgcatttacattgttatttcactatatcttcatatcagggattagctccatgtacaaatgacgggcatacctcaagttattctatgttcacaaagccagaattcagacccaagactcttcacttggtctccaactcaggtgtcttcccactggaccatgtcaatctagtcagaaatacctagatgcaacttgcaattgttctggaagcctacccagaggttagtgtccaaaacattgtgatagcagaaaactggatctgattcctgatgttagtgacaaagggctatgttctatctagataacttgagagtatgttttaaatgccacaaattgaatagagggtggagcaaaatagcatatggatatatgtataacatttatattatctttattgatgacttgaaaagtaacttttcacattaggatccaggatagtttcagttttgataaaggttaaaaatggaaggggaagccagcacagtagctcacgcctgtaatcccagcactttgggaggccaaggtgggtggatcacctgaggtcaggagttcatgagcagcctggccaacatggtgaaaccccatctctactaaaactacaaaaattagccgggcatggtggcaggcgcctgtagtcctagctacttgggaggctgaggcaaaagaatggcgtgaacccaggaggcggagcttgcagtgagctgagattgtgccactgcactccagcctgggcaacagagcaagactcagtctcaaaaaaaaaaaaatacaaaaattagccgggcatggtggcaggcgcctgtaatcccagctactcgggaggctgaggcaggagaatcacttgaacccgggaggcagaggttgcagtgagccgaggtcatgccactgcactccagcctgggcaacagagtcagacttcatctcaaaaaaaaaaaaggaaggggagagggaaaaagtacaacctctagcatttaaaccactgtgtcattggaagccaaaggcaaaagaatcaaaagataaatcttatccagacttataagcagacaaatattccatggaatacttgactactgaaaattgtcaaagcaatactctaaggctgttattacagtaatttgaacaaatggtcaatgggtcattgacacaagtttaggtaggttgaatcaaacaggaggaggtataattttaatcctagtacttatattaaggaaacataatttaatagtaaatcaatccagctgaaaaagagccatttaatttaatcagaacatattagctaatgtaacagttctacctaaagagtattgggaaaatatgtttagtatcttcacaatgagcccaatcattacatttgttgttaaaactaaatttcatggctcacgcctgtaatcccaacactttgggaggccgaggcgggtggatcacctgaggtcaggagttcaagagcagcctggccaacatggcgaaactccgtctctactaaaaattaaaaaattagccaagtgtggcagtgcatgcgtggaatcccagctactcagggggctgaggcaagagaattgttttaacacgggaggcggaggttgcagtgagccgagatctcgctactgcactctagcttgagcaacagagcaagactccatctcaaatacataaataaataaataaataaataaataaattcaatccatcaaaaaattaaaaatagaattaccatatgatccaaccatactatttctgggaatatatccaaaagaactgaaagaagggtcatgtaaagatatttgtacacccatgttcatagcagcattattcacaatagtcaaaaggtggaagcaacctaaacgtccgtcaacagatgaatggataaacaaaatgtggtatatgcatagaatggtatgttattcagccttaaaatgtaaagaaattctctcacatgctacaacatggatgaatcatgaggaaattatgctaagtgaaataagtcagtcacaaaaagacaaatactgtatgattccacttatataacatttctaggggaatcaaacacatagaaaagagtagaatgggccaagcatggtggctcacacctgtaatcccggcactttgggaggccaaagtgggcagattgcttgagccttagagttagagaccagcctgggcaacatggcaaaatcctgtctctacaaaaaaaatacaaaaattatctgggcatggtggtgttcgcctgtagtcctagctactcaagagacctaggtgggagcatcgcttgagcccagaaggtggaggctgcagtgagttgtgatcgcaccactgtactccagcctgggcgacagagtgtgacccagtctcaaaaaaaaaaaaaaaaaaagagaaagaaaagaaaagagtagaatgctggttgcaaggggctggggagaaggaaatggagagctattgtttaaacaataatgggtataatataatataatgggtaatgggtagagtttcagttttgcaaggtgagaaagctctgtggttacttaatgtaaatatacttaacactactaaactgtacacttaaaaattattaaagtgataaattttatgtacagtttatacaattaaaatttttaaaatatgaagtaaaatgaaataaacattaaaaaaccaaatgtcacatagaatactgattcaatcatgtagtaaaatagatccaagtcctcttagactggaatcatactctaagaaaaataattacttttgtggactttgttatctttttgttagattttatgagaacctgacagtaagatgcaagaacatatcatcaaatatactaatatttgcagagggcttcctagaaacaagaatcactaatacattttcacaatctggtgaaaagtttgataaacttaaatgttaaaaaaataatttgtaaagttccattatcagccacatatttttcctttctttttctgttacctaagttctgaacacgcttcaggaagaaaacttagaaaaagataaagattctccacaatatttcaaataatcttttggttcttatttcaaattttcaaaccccactaagggatcaggaaagagattcctaacttctgaaatgccatgggagtcttcaaataagcatttcatatgccagcacaccccgtcctcaaaaataaaacccgacctgtttgagagaccattaccttccgaacaaagttgacatggcattcacccttctgcacaagtggagggcagtctgggggaacctggtagcgagtgtgagctttgctctgctgtgctgcatacaacaccgctgactggaaacgcagctcaatggagttcacgtccctgaccacgttggtaatatcaaagctctaagttaaagggaacaatcagacaaacccatgatgtggaagtagtcttgtgtgtaaaattttagataaaggcattttgtatgaaagacacataatataatgccgatctaggtttagcctccttgcaggagggaacacttctctgaaacactgtagtatctatcacttagttgcccacttttagttaaaactaagcatattttcctacccaatccaagtttctaggcttctccttctatttttcctggcaaaatgatggtcctagggaaatggatagagcaaaaaataactttagctctggaatgtctgctctgtctacttatatgtggccttgaactgccaagggtttcctagacacttcatgacaacctgcctctccggtatgaacagcatgcatttctaagtaatgagttatttttgttttgaaaagtctacctttgaaaggaaaggaagatcagcatataatctcttaatataactattccagaaaggaaatgacattttattttaaaatcatttgtccaatgaaactgtatcagcagaggagggattggcatgttttgaacacttcctatgtgccaagaacttgccaacattttatacaattagcttactaaatccccacactaaccccatggggtttgtaaggtttccattattccacaaatgtggcaactgagaaatcaagtaactcatccagtgctttaatgagctcatatttgtcacatggccaattatgcatttacttttctctactcacaaaagcaattaacataaacacacataaattttttttaacctaatgtcattatatacttacatatctattgaacatattgtctgtttccccaatagtgacttcattgaacaggatttttgaaaccgtatccactccctcaagaatcaaatttactttttgccatttgctaaaaaaaagaaaagatttttaaaacaagatgtgtaaagcattaacttagataagtctcttttttattatttaaggcctaaagaaataaatattccacaaaaaatatatgttcttaaaaggcagtttccagtgacattttcagaagtactgctttaaaacatacttacgtcctttgagtgatccagcttatctttctctataatgtatcaataaatcaccataaaaccaagagcacaacttataatttccaaatatattgactttttctagttaatacttcagaaagctattatgagaaccaagttaggccaggagcagtggctcacgcctgtaatcccagcactttgggaagcctaggcaggcagatcacctgaggtcaggagttcgagaccatcctggccaacatggcgaaaccctgtctctactaaaattacaaaaaactagccaggcgtggtggcgggtgcctgtaatccaagctactagggaggctgaggcaggagaaacacttgaacccaggaggcggaggttgcagtgagtggatatcccaccactgcacttgcaagattccgtctcaaaaaaaaaaaaaaaatgagaaccaagttaaataatagacataaaatgttctcacaaactacatttactgaccctgtctaagagaacacgttagaaaactatcatctataagtgaatattatgcacccagcactctgctaagccttacaggaaactataacagtgcctgtacttaaggagtctgcaatctggttggcatttggtggctggctggcaatattgttgaacaactacaagtgctatcagagtttatctcataagaaaagatttcaaaatggaaacaagaacttaatgaagagaagaataaataaaatgtgttgtattcatacaataaaatactattcaacaataaaaaggaatgaagtactgatacatgctacaacatggatgaactttgaaaacattattatgctaagtgaaagaggcggtcacaaaggcccacatattgtatgattccatttatatgaggtatccagaacaaggaaatccagagggacagaaagtaaattagtggttcctagggctggggtaagaattcaggggcaggaggagtgggcaatgggaaatgactgctaatgggtgtaactttttgtggggggatgaggaaaatgttctaaaattgattgtggtgatggttttgtaactgtaagtatactaaaaaccattgaattatataccttaaatgactgaattgtacaatatgttaattatatatcaataaagtattttttttaaaactaggtagaaatgactgggtggaggcatttctactccccttataccctttgctctttgcaggaaccccttacccctgcaaagagcaaaaccaaaacaaggaagtgctgacagcatgaattacttttaggtaatcgactcatatgtgtaatttgggctggggagctaaggaggaaaaagctggacaaatccaaggggcagagaggtgcgggcagtgttacagggacagacatctttcagctgtattttcacagacaagtgagaagtttatacttgatttgccaagtaaaatagacacttgctattcttgaacgaatacctatcttggcacaatcaatattctgtgatgattaatctaatgtttctaaattgaaaagattggagaataaaagaacaaagcaagaaatttgattaggcagctttggcctctttcctggcactcttctaggcaaagatggaaagatggaaatgagatggaaggggccaaaccaagagaaatgttaaacaaaaatttgcaagacccacccagaacagactgaacacaggaagatgaagaaaagatgtaataagcccaaagcaccttagacatagactggaaaatggtgttacattaagaaaaacaatgaagctgttagaatataaagttagttttaagggggaaaatcaattggatatgttgagttcaaggtgaaatagaaccattacgaaagatattctaaatattatctgtaaataaaagcctggagcacagcagtaactccatgatattgataacaatattctggccttttcccccctttaaaagactagtaaataattaccaaaaaaaaaaatcacataaaagggacagaaggattttttttttcatttagcagtagtggtggtacctttgggtaacgttctacctcatatggaaatatttgcttataataacagaacattactgaaaacagtatctgtgcttcacctcctggcttcaccacatagtataggtcaaggtcatagtctcaatggctggttagcactacatagggcataaccactggaaaaatgactccataagacacaatttggtgactgttgattagtagcaccatcctcatatacaaaacaaaacataaataatatattcacttttatagtacaaggctttcatcttacttaactctcagatatgtaacctaaacaaacaaaacaaaacaaaacatacaaaacaaaaaaaaaacaaacaaaacacaacatttttgcccagatagaaaaagaagaaaagttcaaataataataaaaatacacccacaaacatacatacctaatttcaaaggggattttaaattctttgctataggtccagttatccaaagagacccatctgtagttaaggtcattaaatctgtagtaagaatcctgttgatacaaggtaaaaattatggtagatggttaaatatgcacaaataaattaataaaacaaacataaaataaattattaacaacagctatttatcacctaaaaattaacgaacttttagcctagtagtacaaagaggggacagatcgttaatactgaaaaatgtgaagggaaaattccaacaaattacctgaaatgaaataatcctctgagatataaataatacagcttcattatcaaagaaaattggtgggcattaagattggcttccccttggagacagggtttcaccatgttggccaagctggtctcaaactcctgacctcaagtgatccacctacctcagcctcccaaagtgctaggattacaggcatgagccatcatgtccggcctacagtttatcttgtgtactaacctgtttcactctctaaatgagcaaagtgggagatcactgtcacggctgaagttacatggccaagacaaactatggtctgggagtcccaggttctcctgtgtgggcactttcctggaagatgctaaatgataggaaaatctgggtttcatgtttctgtgtggtcctcacctcacttgacttctgctctttctgtttgctctgggcttccgtgctctcattgatatagttctcagttttccattggtctgtatcccattctgccttggacatctttacttcttgctgctcactgatgaatcaggaggcctgtcctggagatgagcttggtataggccaattgcacatgggtctcagagcactccatcttcaaggtccagataacatgagaaatgagtcttctcacatcattattggggatgaggggccgtagctgctggtttagctgaatttcaaactgatcacctggggacgagagcaatgggtaattgaagcttttgggctcgggagacaggccagtgcccatgttgttgtattcccattgtgtttcacagtcttctctaagttgaacgcagtctcagcagaatctccctcaggaggatggttgtaggttgtgttttcagagatggtgccttctggcatagtagtgttttccataaaaatgttttgttcaaaggcatttcttgcagtggtgcttttaaaacattctgatggagaaatacttccggaaaaggattttcctgaagactcaggtctcctaaagatgaaaaagccccttgtgaaggggcatttatgaggcttttcactgcagagaatggaggcctctttgcaagcaaagtctactgagagaacttttctggaatgtacgattggttttaactcaactttgcattttctaaaaccaaaatgggtaagtctttcaatctgtttctgaccacaggtagggcttttgcaggggtggagatagaaggcacgcccatggagaagggtttcagcaaagagaagactgctgccttatgctcttggttgaacgaaggcttggtatagatggcgtttcctgctaacttctcatgcccctgctctatgtgaggctgttccagctcccttggggctggactcctgagccttttttctttggcagcattctccacaaatgcccaggcaccctgttccttcctgttgctctgctttcccacctctttgaagtgacttttctggatgctccttgggcccatgaggattctgttcactctctgcaggcttttgcctacactttgaatcttagccaggctgttttcctgtggttggacagtttctaatttcatgagtttttggatgcagattgaagagagggactctttgtatggtttttcggaatacccatctttcacatttgaaaaaaacaggtaactataaggttagctgttggcagagctagcagaggttttattttggaccaaaaaaaaaaagcaattgaattgttttgtagctgaaggcataggcatggggggtccccaggtagtaaactaccctgtgggtgggttgagggctagggctgggcctcaggtgggtctcacgttccctgtgctcccttctgctctctgggagagtcgcaggaggggcaggctgggaggggctgccgcagctgttcacttgggcaggacgtcagaggactaggacaccagcctcccatcatgggtctcgatcttcttcacaaccactgccctggtggtgctggtgcggctgaaggagctggagcccacaccagagccaaagctggggcttgggaggcccccacaggccgagctcagatcacctgcataaccactggtggtctttgtatggatactcatgttctgcatcccagagtccagctggctctcctcgccctccagcagcttcctgtaggtggctatctcgatgtccagggccagcttgatgttcatcagttcctggtactcaagcagttgccatgccatgtcctgcttggcctgctgcagggcggcctccagcttggacagcttggcgttggcatccttaacagccagccccctgtgctgcagacatctgtgatggtgccctccagggaagccctctggcctttgaggccctcagtctcagcctggagctggctgatgttccggttcatctcagaaatctcagtctttgtacactgcaggtcatcctcgtgcttcccagccagcatctgcagctcctcatccttgatctggtacatgctctcagccttggcctggctgcagttggcgatctcctcgtatggtgccttgacctcagcgatgatgctgttcatgcccagggagcggctgttgtccatgggcagcaccacagatgtgtccgagatctgggactgcagctcctggatctcctcttcatacagctgcttgaggaaattgatctcgtcagtcagcccttccaggtgagactccagctctaccttgttcatgtaaccttcatccacatcctcttgatgaggacaaattcattctccacctctgtacacttattgatctcatcctcatacttgttcttgaagtcctccaccagcccgggcatgttgccaagctccgcctccagcttcagcttctcctggcccagagtcttcagctgctgcctaaggttgttgatgtagctctggaacatgttgtccatgttgctctgagccatcttctgctgctgcaggaggctccacttagtctccagcatcttgttctactgctccaggaaccataccttgtctatgaaggaggcaaacttgttgttgagggtcttgatctgctgcttctcctgggtgcgcacagcctggatgttggggtccacctccaggttaagggggctcagcaggctctggttgactgtgatggtggtgatgccacccacgctgctgccctcaccatagcctccgcccagacaaccttggaagctgctgctgcccactagggagaagcctgaggagcttatctggacactgggcccacttgtgtaggagtggctgctgaaggcccggggcccagaggtggacaccttgtaggacttctgggtcaccctgatggacatggtggaggcaggagtgggggcaggaaggccgaaccagatagagatcccagaaggagtggagaagctgcttcttggtcttttcagttaactttaccacatatcgtctcatgaccggaggaatttacaagagggtataacttagatttatccacatttctcatgaccttccctgtgccacctggagggctgtaagcagggtttgcttagtgtagcaagtcggcaaccttgctgtggcacctagataagggttcaggaatgcagctgcagagtattcggggtaagggtcagctgcactgcgggggcggttcctggggcagctcgtccctaacagtaacaacattgattctacatcttatagatttttctatgagaaataaggcaagacgtaatttagtgcgtcattgatgtctagctgctcactcccaaagcctgacaagttgatgccattgctgtctgaggccgcctccagctcagtagtcagctcagtgctcgtgtgcttcttccgggcttgtaataccttcatgaacgctccttctggattccctacagatagatgcttcttcaactgtcaggtaagacacaataagtctttctgagtttctcttatagggtttagcttgttaatttccttatcctttgtcctcaaactcaactatcttgttcttccttgcgcctagttaccataaacagcctacccgcttcccgtcagctctaatcaataactcacatctgttcccttggttacctgcaccccatgttcccctgaaactgcacatctcacacgctccacctctgtccccctccccttctatatttaaaaaaatatgtacaagtagccaattgggtcagctcaaactgtgcagtccaaccccagcccaagggggagtagcacagagatagggactgcgttgaggataaaaaccccctggtctcctttgttctctgtgctcttgcgatcttgattgacgcaagtggcacccttctgcagaagtaaattgccttgctgaaagaattaaaaaaaaaaaaaagattggcttccccttttaaaaccaaacacaaaaccaccagtatcagcagagaatgaaagactgaatctgtggtgtgtagccagcagtctctcattgccctgtggttctcactgtgctgtttgcgccactatcccagccagcctccagggggaatacttctctactgcccaaaagtcagcacaactcccttccgctcattggattcacttagcatttccagttatttttcacttagctaagtgagcatgaaaaggatctctacagagaatacacaggcagcagagatacttcaaaacttattaacatcaggtttcttatattatcctacctcaggtcagcaaactgccacccacaggccacattcagctcactacatgtctctgtgtggctagcaagctaagtaagaatggacatgtgcccataaataaagttttactagagcacagccatgccctttcctttgcaatttacatatggctgctttggtgctatagtggcagagttgagtagacatgatggagaccatctggccctcgaggtctaaaatatttagtatttagctatttactgaacgtgtttgctaacccctgcccaagatgactggcctcctagatgttcatagatgttgctccatctgagtgtctagacccaagtctgcctcttcataaatccttaagtctttcttctcctaccccctttccactctttttacacttttttttttgagatggagtttcactcttgttgcccaggctggagtgtaatggcgcaatcccagctcactgcaacttcagcctcccaggttcaagcgattctcctgcctcagcttcccaagtagctgggattacaggcatgcaccaccacacctggctaattttttgtgtgtttttagtagacatgggttttcaccatgttggtcaggctggtctcgaactcctgacctcaggtgatctgcctgtctcagcctcccaaagtgctgggattacagacatgagccaccgcatctggactctttccactctttatctcccagaggaatactcaagacaggaggcagaacagaaagtggcaaacaaatcttttcagttcatctatccatgaacaatatatagaagggaattgtgcaggcatggaggggcttcccctcctttgtcagggacagatccaagttatttccttagggaccgtaactccaagtcaagaaggaaaagccaactctgtctaagttccacacaggtaagagccagatgaacacgttaggctggcaatggccagttaggcagttgcccagggcaaatctgtaagaagcactacaacatcagtgggagtgtatcaagatcaagataggtatctgccagaaactgatccaaactggaagaaatattttgataagctactagaggagagagtgactgatgagatttaaaacaacacgtaatcaccaaactggcttttaaggtctggttaatggtaaggttttgttctgttaaatgccgtgtgccaagcccagccaacttatctcccacacaggactcggcctctccaatgaacaaacatggaacacatatttacagacacagggttgaagaggcacctaattattagcatgaccatgtcactcccccaagacctatttataactctacactgtggacttagtccaatacagttaaaaatatcatgagaaggaaggtgtgagagcaattcagccacaacacatcaacacactaagcccgggggctggctgatgatctggttgacggggcacaagtccccttcctttctcccagctccctgaaggaatctgcaagttggttcaagagggcaatcttcccagatatattttttcgacacaaacataatttataggttaaaattttatcttaaagaggccaatctgaaaaacctaaataatgtatgatttcaactatatgtcattctggatgttaaataaaaattacaggaggccgttgttgactgagctcctatactaggcctcagcagaccagatcaaaccaaaacagtcactcatgctaagtaccacttaatcaaactgaaactttaacgaaggaggtagatccgcaaacagggcagtttttcctgaaaacttgagattcctgttcacctgagtaaggaagtcctctctgcattttttttttttttttttgaaacaggtcttgctctgctctgtcacccaggctggagtgcagtggcacaaccatggttcactacagcctcaacctccggggctcaagcaaccctcccagctcagcctcctgaggagctggggctacagatgtatgccaccactcccagctaattttttatttttatttttttgtagagatggagatcttactatgttgccaaggctggtctcaaaatccttagctctagcaatcctcctaccttggcctcccaaaatgctgagattacaggcgtaagccaccacactggccggttctctctgcttttaccctttctagaaaagtaacctgaagtaatctgatgttaatcaatcagtttttttcctactgttctgtttctttgttccttacaaaacccactattcttccatggccccatgaaagtgctcactgtattttgtagaatggatgctttcctgattcatgaatcacaaataaaaaacaatttgatctttaactacatttgttgtaattttgtcttttgacatggaaaagaaaaaactatggagacagtgaaaggatcagtggttaccataggttaagcagaggagaagaatgaataaacagagcacagagaatgtttatggcacggaaattattctttacaatattgcaatggtgaatacaagtcattatacatttgtccaaacccacagcatgtacaaccaagaatgaaccctaatgtaaagtgtggactttgactgataaagatgtgtcaatgtctgttcattgattctaacaaatgtaccactctggtggggaatgttgaagaatgggatgctgtgcatgcaaggaggtaggaggttatgtgagaaccctctgtactttctgttcaattttgctgtaaacctacaaagtctactcttccgggggagaagggcagcagcgtgagagttggctctgaagagtggtgagtcagaagagacctcaggcagcaagcgacttgggccatggcctctgacctagacttctcacctctggaggtgcctgagcccactttcctggagaacctgctatggtacggactcttcctgggagccatcttccagctcatctgtgtgctggccatcatcatacccattcccaagttccacgaggtggaggctgaaccatctgagctcagaagtgctgaggtgacgaggaagcccaaggctactgttccttctgtgaacaagaggcccaagaaagagaccaagaagaagcggtagaagaggaggcccgaggagccagacaggcagggagagggccttggggacagccctcctgggaatctatatcctgttccccctctccatcccaggttcagggtctgaggaggctgtgacaccctctgacctcagagatctagacagtcatgacagtccccaggctccagctgtgcagtccaccacttcctcttccttctgcttctgtgatggtttagagtcaaggggactgaaacacactgtgactgtattaggaggtttgtttagaagttgggtcagctcacagagtcacattttcttacttagtcatgtgtccagccttgagtcaccccctccttgtgagtttacattacattttggagtcattatctaatgctgacaagcccaccctctcccattatttgtgcactacagatctcctgctaatcagtcaccttttttgctgctgtgtagacagagccaggcctcacctgtttgtttaggccaaaacgccatggccatgcaatgttagtgatcccactagctgcgacagccaggcccagaaaatgcctgacatgagagccagcagacagcccaggccagggtaggcagtgcctgcttctgctctgtcaggtgcaagggatttggctgaaggcatgcatatttcctggacacaaacttcctgagcttctgaaatgggaggctcatcaatttcagaccaacctcttttcaacccttcaacccatcatagcacgttcaaggtgtgccttttacttccacctgtacatcccccattccttcaattctttcattccctaaccagagagagttcctgggggaaatgtggcgaataaactgcatgcatgctgaaaaaaaaaaaaaagaaagaaaagtctactaaaaatttttctcttactaagagaaaataccaaaaaaaaaaaaaaaagttatagaggcttaaattacatttaaaataactattccaaaggccaatcaaccaacctaatttggttccaggttggtctgaccctatttgatcatactgaaattctgagccttatttatagcaaacagcagctcagggttacctctcatgactaaggacccatgtcagcctgagttgttaagcaaacccatgaaccctaaaacaaataaaagtatcatttgtcaaccatttactatacatcagcctctaaagtaggcactcatacactcttatcttcataataaacacgtacagtaaataccatttaatagaggaagaaactaaagctccaaaaagtgaagtagctttcctgaggtgccacaactaagcagaagtatgtacactgaggaaagaaaccaatctagtctaacaccaaggtctgaattttttggactatactacaatgcctcatgctacatatacttacacgtttataccagctggtaactgcaacaacaataataatagttaaaagttactgcctgtgaccctagtggggtaggtactattatcatacccatttaccaacaaagactctaaagctcaactcaaatggctattaagtggtggaggactgactcagaaccaggaaagatggctccagggtccatatacttagtcattacctagtactaccattaacatcacaacaccaccaatagttacaatgtcagtgcttataaagcagcagccatgaaataaacatgccgtgtgtgcctcggctagtgatttataattgatacttaccatatttactatgtttactgtacatcaacaaaccatgtgtcatcagagcatgcaaatgacaatatcatcagtctcattttctcagtaagcttctggactccatcattatacctgattatagatacagagactacttaaccaggtatagcttttccactccccagttctgcttcagaccaatgtcagactttaccccagatacaattacttcgaatagaattaaatggagaaagttttttcaactatcttgtttacaggcgttgttttcttagacacttgggcaaaaataaataaatagatgttaagaaaacacttatcaaaaacaagcaaaatgtggattaggatacataattatctggcaaactgagataaaacggcagataggagacaggactaacatgcagctcccacttggatgaacagaacagcatgtggagactcacactgtgaatttttgctccaagaaccaccacaggaacataccgggaaaaccaaaagaattcaagaccctttgaaacaagtggtttgccactgcaaattctgtgaaacagccaaaaactgtgagttcccaaagtgtgagagggaaaaatgtctgcctccaaacacacatcccctctgggaacctgaaaattcagatcacgggagaaggatttaaccttacctagagctgaaatggatttcaggagccaagcaaaatataatagtaccgagaaaagaagcaccggaaagagcgagtccccagcttgagtccagggaagccattcctggcctatctcacagaggtctttggggaagggaaggcacccagcagaactggaggggagtcacagggtgaaggaagctcccggctgaactttgtaatattttcgacaagcatgaattttcctgagcagaatccaggagcttgggggtggtgaacaggaagaacagatatgagcacagccaaaggtgtgagcaggtggggaggggtgaggcctgagagccatgtttgctttctcagcagggaggcttatagcctggggcaagatctcagtcctgctcaccggctgcctggataggaactgatataaagtcagtgctgttgggggggcacagtaggagtgagactggccttgctggcttcatggaagatgggtaaggcctgtggtgttttttttgtttgtttgttttttttttgaaatggagtctcgctctgtcacccagactggagtgcagtggcacgatctctgctcactgcaagctccgcctcccgggttcacaccattctcctgcctcagcctcctgagtagctgggaccacaggcgcccgccaccacgcctggctaattttttgtatttttagtagagacagggtttcatcgtgttagccaggatggtctcgatctcctgacctcgtgatccgcccgcctcggcctcccaaactgctgggatgacaggcatgagcgactgcgcccggccgggtaaggcctgtcagtgctggcttttccctagcgaactgtatgatgcagcagaggcaatcataatccccctggcaacataattccattagcctgagaaccccatagtggccatggcaggccccacccaaaaagagtctgagctcagaccctaaccctgtcctcacctgatggattttctctaccagacctggtcgccaaagacaaatgacataaacccttgggacctctatggtcctgcccatcacctgagaaacccaagtactcatcctggccaatgtagggcaatattatatccccccttctgctactgcagctagtgctttcttgacagggccacctcctggctggagaccaatcaactcaaactgataaaagaacaaccctgctctaaagaagaaaacaactaattccactgcctaaagaagaaaacaactaattccactgcctgcaatatcctggttaaccagaagtactgagtctgttcacatgacaacttcactgctagcataaccagcatttgagaaagccagtgcactaaatgaagctacaaccaaggactcccactttactcccctgccacctccactggagcaggtgctggtatccatggctaggagacctgaacgtggatcacatcacaggactcttggcagacagtccccagcatcagcctgcaggccagtagctccgctgggtggctagactcacaagggcaataacaatcactgcagtctggctctcagaaatccccgtccctaggggaagggggagagcatctcatcaagggaataccccatgggacaaaacaatctaaacagtaacccttgagttccaaatctttccactgaaacagtctacccaaatgagaaggaaccagttaaagtaattctggtaatatgacaaaacaaggttctataacacccccaaaagatcacactagctctccagcaatggatcgaaccaagaagaaatctctgaactgccaaataaacaattcagaaggttgattatcgggttactcaaggaggcaccagagaaaggtgaaaaccaacttaaagaaatttaaaaaacaataaaggatatgaatgaaaaggtctccagagaaacagatatcataaagaaaaaacaatcacaacttctgaaaatgaaagacatacttagagaaatgcaaaatacactggaaagtttcaacaatagaatcgaacaagggaagaaaaaagataaatgaaacaaaaactggctcggtgaaaagataaatgaaattgatagaccactagtgagattaatcaagaagagagaagatacaaataagctcaattagaaatgaaatgggagatattacaattgataccacagaaatacaaaagatcattcatggctactatgaacatctttatgtgcacaaactaggaaacctagaggaaatggataaattcctgcaaatatacaatcttctcagattgaaacaggaagaaatagaaactctcaacagaccaataacaagtagtggtgttgaaagagtaatttaaaaattgctgaccaaaaaaaagtccaggaccagatggattcacagctgaattctatcagacattcaaagaaagattggtaccaatcctactgaaaatactccaaaaaatagagaaagagggaatcctccctaaataattatatgaagccagtactatcacctaccaaaaccagaaaaggacataacatacaaaaactacagaccaatatccctgatgagcatagctgcaaagagcctcaacaaaacactagctaaccaaatccaacaggataccaaaaagataatacaccatgatcaagtgggtttcataccagggatgcaggtacatatgcaagtcaataaatgtgatacaccacataaaaaagaattaaaaacaaaaatcatattatcaactcagcagatgcagaaaaagcatttgacagagtctagcatcctttatgattaaaatcctcagcaaaattggcatagaagggacataccttcaggaaataaaagtcatctgcaacagatccacagccaacattgtactgaacagggaaaagttgaaagtattccccctgagaactggaacaagacaaggatgcccactttcacaacttctctttgacataggactggaagacatggccagagcaatcagacaagagaaagaaataaagggcatccaaatcagtaaagaggaagtaaaaccgttgctgttcactgatgatatgatcatatacataggaaaccctaaagactcatccaaagagttcttaacctgataaataaattcagcaaagttttgggataccaaatcaacgtacacaaatcagtagcactcctatacaccaacagcgaccaagctgataatcaaatcaagaactcaaccccttttacaatagctgcaaaaaataaaataaaatacttaggaatatacctaaccaaggacatgaaagacctctacaaggaaaaccatgaaacactgctaaaagaagtcatagataacactaacaaatggaaacacatcccatgctcatgaatggataaaatcaatattgtgaaaatgaccatactgccaaaagcaatctacaaattcaactcaattcccatcaaaataccatcatcattcttcacagaactagcaaaagcaaacctaaaattcatataaaactcaaaaggagcctgcatagccaaagcaagactatgcaaaaagaacaaatcctgagatatcacattacctgacttcaaactatactataaggatatagtcacaaaaacagcatgctacaagtacaaaaacaggaacatagaccagtggaacagaatagagagcccagaaataaagtcaaatacttacagccaactgatctttgacaaatgaaagaaaaaaataaagtgaggaaaggacaccctattcaacaaatgatgctgggataattggcaagacacatgtagaagaatgaaactggatcctcatctctcaccttatataaataaatatcaacttgatagatcaaagtcttaaatctaagacctgaaaccattaaaaaaaaatctagaagataacatcagaaaaactcttctagacattggtttaggcaaagacttcctaagaacccaaaagcaaatgcaacaaaaacgaagataaatagatgggacctaactaacctaaaaagcttctgcacagaaaaagaaataatcagcagagtaaacagacaacacacagagtgggagaaaatcttcacaaactatgcagccgacaaaggactaatatccagaatctacaaggaactcaaacaaattagcaagaaaaatcaaataatcccatcaaaaagtgggctaaggacatgaatagacaattctcaaaagaagatatacaaatagcagaaaaaatttaaaaatgtttaacatcactatcagggaaatggaaatcaaaaccacaatgagatactcctttactcctgcaagaatggccataattaaaaaaacaaaaaataatagatgttggcatggatatggtgaaaaaggaccaattttacactgctggatggaatgtaaactagtacaactaaggaaaacagtatggagattccttaaagaactaaacgtagaactaccattgatccagcaatcccactactgggtacctactcagaggaaaagaagtgataatatgaaaaagacacttggatacacatgtttatagcaccacaattcgcaattgcaaaaatatgaaaccagcctaaatgcccatcaaccaacaagtagattttttaaatgtggtatatgttatacataatatggaatactactcagccacaaaaaggaacaaaataaagtagagttggagaccactattctaagtgaagtaactcaggaatggaaagccaagcattgtatgttctcacttataagtgggacctaagctatgaggatgcaaaaggcttaagaatgatatagtggactctggagacttgcagggaaggatgggaaggtgagggataaaagactacacattgggtgcactgtatactgcttgggtgatgggtgcaacaaaatctcagaaatcaccactgaagaacttcatgttaccaaacagcacctcaggaggtcatggtttttttcctggtaaagtgacccaaaccttcattcctgaagggtctgggccatttgtagtcctgcccagattgggctgttgtaatttcccattgaccttaatctcagggcatggtaatactatgagacaccccaagggatctcctgtattccacgcatactcttccttatctccattgtggagcagtagactgattttgtcttgatagtctgggtcaatcaccctagccaacactgtaactcccttcttagcccactgacttaaacttaggaggagcccgaagtgtccaggtggcaatcttaacttctagtttaatggaatcattgtgtctcctggtggcagcgtttctccctctggaactaagacttctagaccagcagaacgtaatgtcgcaggaacaggaagcaaaaattttgctagtggatcactaggggtgatggtgagtggtaccacttccacttccatcccttgcttcctggacctatgaatcttggctatgggagaaacagtaccatatattgaatgctgattcagagcatacatggtcttctggagaactttgccgcagccctgaaaagtattgtcacccagttggcattgtaattgtgactacagaaggccattccaccattctatcaatccagctgcttcaggatgataaggaacatggtaagaccagtgaattccatgagcacgagcccactgccacacttctttagctgtaaagtgagggccttggtcagaggcaatgctgtgtggattaccatgatggtggataaggcattatgtcagtccatgaatggtagtcttggcagaagcattgcgtgcaggataggcaaacccatatccagagtaagtgtccattccagtgagaacaaacctctgccctttccacgatagaagcagttcaatataatcaacctgccaccaggtagctggctgatcacccccaggaatggtgccatatcgtgggctcagtgtcggtctctgctgctggcaaattggacactcagcagtggccgtggccaggtcagccttgctgagtggaaatccatgttgctgagtccatgtgtaacccccatccctgccaccatggccactttgttcatgggcccattgggcaatgacagggatggctggggaaagaggctgagtgttgtccacagaacgagtcatcctattcacttgattattaaaatcctcctctgccaaggccacctgttggtgagtactcacatgggatacaaatatcttcatagtttttgaccattcagagaggtccacccacgtacctcttccccaaatttctttgtcacaattttccaatcatgcttcttccaagtcactgaccacccagccaaaccattggctacagcccatgaatcagtatataactgcacatctggccatttttctttccatgtaaagtgcacaaccaggtgcactgcttgaagtcccacccactgagaagatttcccttcactgctatccttcagggatgtcctagaaaggggctgtagtgctgcagctatccactttcgggtggtgcctgcatatcgtgcagaaccatctataaaccaggccctagtcttctcttcctctgtcaactgataatagggaactccccatgaggccattagtgcaggctgggggagagacggcagggtggcagaagtgagccacttctgcctttgagccacttcctcatgtaacttaactgtgccttcaggacctgctcgagcccaatcatgtatataccacttccatttgatgagggaatgctgctgtacacaacctactttatggctagatgggtcagaaagcacccacttcatgataggcagttcaggtcacacagtgacttgatgacccgtagtcaaaggtttggtttccaccaaagcccagtaacaggccaagagctgtctctcaaaaggagagtagttatctgcagaagatggcagggctttgctccaaaatcctagcagcctctgccatgattcagctatgagggcctcccagaggctccaaacaccatctctatctgccactgatacctcaagcacaattggatctgctgggtcatatggtccaagtggcagagcagcttgcacagcagcctggacctgttgcagaaccttctcctgttctggatcccactcaaaactggcagccttttgagtcacttgctaaatgtgtcagagtaacacaaccaaatgtggaatgtgttgcctccaaaatccaaataggcccacaggacgttgtgcctctttcttggttgtagaaggggccaaatgcagcaacttatccttcaccttagaaggaatatctcaataggccccataccactggacccctagaaattttactgaggtagaagttccctgaattttggttggatgcacatgtctcaccaataagtccagtgtgtttggtacttcttgctcactggatccaatcagcataatgtcatcaatgtaatggaccagtgtgataccttgtggaagcgaaagagatcaaagtctcttcgaacaagattatgacataaaaccagagagttgatatgtccctgaggtaggacagcaaaggtatattgctggccttgctagctgaaggcaaattgcttctggtgggccttatggacaggaatggggaaaaagacatttgccaaatcaatggctgcataccaggtaccaggagatgtgttaatttgctcaagcaatgaaaccacatgtggtacagcagctgcaattggagtcaccacttggttaagtttacaacaatccactgtcattctccaagatccttctgtcttctgcacaggtcaaataggagacttgaacagggatgtgatgggaatcaccacccttgagactttcaggtccttgatggtggcactaatctccacaatccctccatggatgtgatattgtttttgatttgctatttttctaggtaggggtagctctaatggtttccatttggcctttcccatcataataactctcaccctacaagtcagggagccagtgtgggggtttggctacctgctacgtatgtctatggcaattatgcattctggcactgggaaatgaccacagggtgggtccctggatttccttccaaggaaggaagtcagacctgtaagtcagacctgagctaaaactccattaattacctgatctccataagcctctacttcaactggaggaccacaatgacattttgggtcccttggtatcaatgtcagctcagagccagtgtccagtagtccccaaaatgtctgatcatttccctttcttcaatgcagttaccctggtaatagactgggggtctccttggggaaggatgggagaaatattaacagcataaatagtcactagcatagtggggtccttttcaaggggacccagcctccccttcattcaagggtttctgggcctataaattttgtggtggagtgactgttgttcccaccgttagatctgacatacagagaagagcaattacaggactcttcagagatgcagttgccgccatcacaaatccatttcgcaaagcgttggtcaagggtgtatcttctggaccctcccagctgggatgggtaggtccaaagtgaccaatccactccagcatccaatctccctaaacttttggatcccttcctctacattaaactgagagagatcaggcatttccagcttgctcacagtgggccatcttttatccatatttcagctaaccaagcaaataaactattagaaccattaaaaccttttttaactccctgagctgcaacatcaaaagcagaatctctacttagtgggttcaaatcaataagtccagcctgatccaactctatattccttccgccattatctcacacccttaatatccattcttatgactcttctccagatttctgcttatataaattagaaaactcaagcagttcttttctagtgtagcacatctcctcaagggtcactctgaacctcacctctaggggtctgctgggactttagtctaggtataggtctagaagcaaacaggggtgttgggggtggctcctgaggagaatcaacgttattttgcctggcaactgcctcagaggaggccatcactgttgcctccaggcagcgcatggtttatctcctcagacaaaggtggaaaggctgatggcagcatgtgttggggaggggatgttgccactactggggatgaagaagctgtttcttctggcaaaaaaggttcatcagagttaacaagctcagtgtccccagcttcattaggccctccaccacacatccccattccaagttgcagggtcccattcttttccagtcaatcccctcactttaacagtagacacctggaaaggctgtgcatgcacctttcgttgcaggtcagccactcacatgataagagcttgtgtctatttttccacaatttcagctctttctctataggagataagactcttacacagggtaatctagcaggtgtgaggctcagtactacttctgaagctgaaaatgaatccctgagctcatcatttttctttcatcactttgtccagtgaacgtaggagcaaccaaccagctttattatgttccttggttctccacatatggtcaaaggtattatgtttcaagtcactaaactccttgcctctcacgagcagtgaatcaggagtatcagatgcatttattttgcataactctctaaacagttcatgccaaggactatgggtgttctccatactattagaaatagaattcttaggccgggcactgtggctcacgactgtcatcccagcactttggcaggccaaggcgggagggtcatgaggtcaggagatcgagaccatcctggctaacatggtgaaaccccgtctctactaaaaatacaaaaaattagctgggcgtggtggcggtcgcctgtagtcccagatacttgggaggctgaggtggcagaatgccgtgaacccaggagtcagagcttgcagtgagcagagatcgcgccactgcactccagcgtgggtgacagagcgagactccatctcaaaaaaaaaaaaaaaagaaagaaaaagaacctttagcattttttggtctaatcacattaagcagccaactccagaaaccccaaaaccaataaaagaactccatccttaatattctgttcctctagaaccacttctggtaccaaaatctgtattagtcagggttctctagagggacagaactaatgggatatatatatatataaaggggagtttacgaaggagtattaactcacatgatcacaaggtcccataacacgccatctgcaagctgagaagcaaggaagccagtctgattcctaaaggtgaagaacttggagtctgatgtttgagggtaggaagcatccatcatgggagaaagatagaggctgggaggataagccactatagtcttttcatgttcttctgcctgctttttattctggctttgctggcagctgattagattgtgcccatccagattaaaggcaggtctgcctttcccagtccactgagtcaaatgttaatctcctttgacaacaccctcacagacacacccaggattagtacttcgtatctttcaatccaatcaagttgacactcagtattaaccatcacaatgtttcattcagaagctatagtctccaaacttcagtttctcctctgtcaaataggatcttcagctatgattcttacttcaaagggtacacaggtacaagagatccccagcccacgagtctggcaacatgttttggtcagccttaacattatctttttctaaaatccttaaattagtaaatattgcttcccatctaacatagctctaagtgaaaaaagttgcagtttaaggagagtcctaattttctgaccaaagagactaaaacttaaaagggaaaacaagacaaactatttgcttggcccactacaagtcccaggcattatgcaaggttttcaaggagacacagagacaagtgacacctgactgaagtgtagcggtggggttcccaggactggacctcatgaaaggttagaataaatgcctgcagacagattcctagctgataggaagagtcagaggagatcacacttgctcagggagtgaggctgggcagctacatggttccactgcctctgagatgaagccaggaggtgactggagctgacatgtggaagaggcagttggtgaaaccttttctgcatgggtttgatccccagcttaatcctaatacctgtgagtctttgtgaagctcaaaaaacatctctgtacacctgttttctcagttcttgaatggagatagtaatcatacctacatgcctcacaggatcagtacaaggagtgcatgagacaattatgaagagtgcttagaacagttcttggtacatagtgtgcactcaaaaatgatagctatcttttctattacatgtactgatctgaaatgatgtctaagatatattaagttaaagaaaaaggtcaatataaaactatatatatatatagaatgcaatcatctgtggggggaaaatacatgtatctatatatgatatctgtctgtatatgtttataacatctatggaagaatacacaagaaaccggttaatcatggttgtttctatagaagggaactggacctagaagacagggatgcttttcataacatagcctacctttaaaactgtttactattggccaggcaaggtggctcatgcctgtaatcccaacactttggggggccgaggtgggcggatcacaaggtcaggagttcgagaccagcctggccaacatgatgaaacaccatctctaataaaaatacaaaaattagccaggtgtggtggcaggcgcctgtaatcccggctactcgggaggctgaggcaggagaatcacttgaacccaggaagcagaggttgcagtgaggcgagatcgtgccattgcactccagcctgggtgacaaagcaagactccatctaaaaagaaaaaaaaaaacccatttgctatttatatcctttacctgtttctaaatgtcattaagattaatttatctctttttttaaaaaaaagaaaacaatgagctaggttgatagcggtagaaatgttaaggaatggttataagacagtatagatgggacttaaaagatccagtacctaacaacagacgtgagaaaaaaaaacaaaaaactgtaaccaagattctaggcttagtttcctgagaaaatacttatgcttttattataaataggtaaaataagagaaagtaagggttgggagaattgagagaagaaatatttggatatatggagtttcatatgccatgaagacattcaggtaggagagttgaacagaatttctagctggaaatcaagtgagatgtggtggttagacacaagcatttcagcaattgtggcacagaagtgatggctgaaacaaagagaattccaagagacggagaatacagaaagaagtgatatatgaattaaccctgagaaaatgtttacattttttgagagcttttagcaaatggggtgcttttagtggcatattttgaacaaaagtatattgtactcatgtctctattttcatcagacacatttaaattaaaataactgttccatttgtttactatttactgtttctgccaataggcagcgtgcaatggtgaaaagaacatcggggtttgaatccttgctccaccatccattatatgcatcatcttaggcaataactttgctgagcctcagtcactgtgaattattataccttttccagagggttgttgctgaaattatatgaacaagtgcacatgaaagggccaagaaaagtgcatcacacgtggaagacataaaataaatgttacatgaaaatgaattgtataggctgactacatgcattaatacttatacatgataaggaccagccaacgcttacctaaaaatttagctctcaggtggtcctttgattttcagttcggggccacgcaaagcaaatcctcccataccctaaatacacctcatgtggcatcaaacaagaaagtatatgtccaggtttaaggatcaggattttttaaactatctgttttttttaaatgagggcttaaaaaccttggacttctctcttcccagaaattgagcaacattattaattgatgactatttctgtttaaattaaatttcaaatgcagagtcattagctattttatctccttaatgtcacacctgatagaagcagtcaaacttttttttttaattttactttaagtcagtcaaacttttagaagaagacatacatatctttaaagggtcatttcctaaaaagcttttgagatcatttcacatcataaaatgatcacgtaaagccaaatatttccttagttttttttttatttaaaaaacattttttatcattctcagtattcaaacaaatatttcatccttacaagtcttaagatctctgtggaaggttagtataacaaccagaaaaccttctgttttgagaaaaaatgtatgtttagtcattttggattataataatgggactctcttctctgaaacacatcaaaaatatttcacaagtcataatggttctgtggttatgttgaagaaaaaggaactccctatcttttaaagacccatactgaaatgtttgtggatgaaataatgtgataactgggattactttataatactaagggcgccaggagcagcggttcacacctgtaatccctacactttgggaggccgaggtgggaatatcgcttgagcctgggagtttgagaccagcctgtgcaacatagggagactctgtctctacaaaaaagaaacaaattagctgggtatggtggtgtgtacctgtagtcctagctacttgggaggctgaggtgggaggatagcttgagtccaggaggttaagcctgcagtgagccatgaccacgccactgcacttcagcctgggtgacagagtaataccctatctcaaaaaacaaaaaaaatgataacaaaacaaaataataagggatggcatagtggatagagaagaaacaaaattagccacgaattgatcatgttgaagccaggtgatggatacatgaaatttcattttgcaagtatctctattttactatttgtttgaaattcacccaaagtttaacaaaattcacatagaaactgcttatttgctacttaaagaatacaaaagtagaatgtacactgatgcacatatattgttagaatgtacttatgagtgataacctgcagattggagactccatagacagactcatggctccttagaaagaatgattgtgggtggagcagacccaaggaggaaaagcagagtccaggcttagactgcagcttctcgcttacctgtgcagtctaattttgagcggcctctttgtagttaagagacaggagctcccattctctctctactaacccaaaagtcttgtgtgtactccttgccttggctcagctccaaacacatttctacaccgataacaagaaatatgctgtaaatgatgtttccttctcaatccctgccgcctctgaatttgctgaccttagtaacatcatcaataaattactaaaggacaaaaatgagttccacaaacatatggagttttatttccttattaagggccagtttctgcgaatgtccttggtcaaacacatggaactggagaacatgtcatcagaagtagttgtggaaatagaatatgtgaagtacacagcaccccagccagagcaatgcatgttccatgatgactggatcctttcagttaaaggggcaaaggaatggatcttgactggttcttatgataagacctctcaaatccggtccttggaaagaaagtcaataatgacaattgttggacatagggatgtcttaaaagatgtggcctgggccaaaaaaaaagatagtttgtcttgcttatttgtgagtgcctctatggatccaactattctcttatgggagtggaatagagagaaacaaagtgaaagcccgaccgtgctgcagaggtcatgctggaagtgcagagtctatagctgttgatagctcaggaactaaattttgtagtggctcctgggataagatgctaaagatctggtctacagtccctacagaagaagaagatgaaatggaggaatccacaaatcgacagagaacacagagcagctatgactcccatagtgaccctctctggtcacaaggaagcaatttcctcagttctgtggtcagatgctgaagaaatctgcagtgcatcttgggaccatacaattagagtgtaggatgttgagtctgacagtctgaaggcaagctttgacaggaaataaagtgcttaattgtatttcccattctccaactttgtaaacgtttagcatctggaagcacagataggcataccagactgtgggatccccgaactaaagaccattctttggtgtcactgtccctaacttcaaatacaggttgcgtgacattagtaaaatggtctcctacccatgaacagcaactgatttcaggatctttagataacattgtcaagttgtgggatacaagaagttgtatgatctggctgctcatgaagacaaagttctgagtgtagactggatagggacacagggctacttttcagtggacaagcagacaataaattgtattcctacagatattcacctaccactttccatgtgggggcatgaaagtgaatgataaattgatcatagagattctttatacaaatgaacttggtagaaaatcatgaaattatactgatgcagatgcagaaagcagccgtttgaaatttatataatgttttcactcttcataacagctaacatttaactatctttttcttattttgtatttataatagtttgtgtttataaaataaaaagaatgattgtgactagcttgttaatcacatgtatagctactatgatgtactcttacagtttatagttaattaacttacacatctaaaatatatctttctctggccatttgtcccaattgcatgtgaagaatataaggtaataataaaatttacggaaaaagtactaagtatctgttgcctaccactttttagtatatgtgtatatttatatacttataatttttattttcaagtgtagattttgaataagaacacatctttataatggggtgtatgaagctatttgcaataatcctggatctatatttacagacacagacaaatatattcatgatatgttttaaatgttaaagtagctaataaaaccaccttaggggatgatttcatttttatgttatatttgtctctatatacttagaaaaaaatgtggaaagataaacacttttttacagtggtctttttctgctttatattatgtgttttattggtttttcttccttctttatattttctgtatttcttttatccaatgaacactacataaatacgtatttttaaaagaattttaatcatgtaacctttctaaagattaaaagagaaggaataacaatattatatcagtatatgcgaatttagtgcatgataaaagtaatatatcagcggacaaaagagaaattcttcaaatcatgagttataggcaaccaattaactatttggaagaaacctcaaatgaatcaaaattttaaatataggaactataaagatagctgagaggaattatttttaagcaaactaccaaagacagaaacaatcataaaaggaaaacaaaagatttcaacatacacagctttaaaacatccatatgacaaaatacttcattaataaatgggacatttggggatttagttttaatttgaatttttgaaaatatataacaaaggggccttataaatctatattaaagaggccacccatggtggctcacacctgtaatcccagcactttgacaggccgaggtgggcggattgcctgagctcaggagatcgagaccagcttgagcaacacggtgagaccatgagaatcgcttgaacctgggaggcagagaatgcagtgagcaagatgatgccacttcactccaacctgggcgacagagtgagactctgtctcaaaaaaaaaaaaaagaaaaaaaaaatcaccattaaagataaatagccaaaagaagatgaattagaaatgcccatgtcaccaataaacttatgaaataaacgtataaaggtatttgaccttactagaaaataaattgattttgttttgtttcttaaataatattcaaatctagcacctaagataagcactctgataaaataatggtggcagtgtacaactggtacaatgtttatgaaaagcaacttagaagcacgtactaaatgactaataaaagtacatatcctatgaatcagctatttaacttttaaatatttgtctaagaaaataaagatgtacagtaaaatttagttaaaaggatcctcatcagaaaaatagaaaaaaatggagtccaatctaactatccaacaataagtaacagattataactgatggtaattgtatataacataatttttaaaaagccactaaacatggtttatagaaacctgtttaatgcaggtaagagcatcacaatacattaaatgtgaaagagttgttatttattttattttatttatttatttttttttttgagatgtagtcttgctctgtcacccaggctggagtgcagtggcgtgatcttggctcattgcaagctccacctcccgggttcatgccattcttctgcctcagcctcccgagtagctgggactacaggtgctggccaccacgccggactaattttttgtatttttagtagagacggggtttcaccgtattagccaggatggtctcgatctcccgacctcgtgatctgccgccttggcctcccaaagtgctggaattacaggcgtgagccactgtgcctgcccaagagttgttaagctgtatatttaatacttataaaagtgtatgcattaaaaaaattagaatggatgcactgaatttttactttaatagtggttatcctgctcaatgaaataaaagagaacacaaacaaatgcaagaacattccatgctcatggataggaagaattaatatcatgaaaatggccatactgcccaaggtgatttatagattcaacgccatccccatcaagctaccaatgactttcttcacagaattggaaaaaactactttaaagttcatatggaacccaaaaaaagcccacattgccaagacactcctaagccaaaagaacaaagctggaggcatcacgttacctgacttcaaactatactacaaggctacagtaaccaaaacagcatggtactggtaccaaaatagagatatagaccaatggaacagaacagagccctcagaaataataccacacatctacaaccatctgatctttgacaaagctgacaaaaacaagaaatagggaaaggattccctatttaataaatggtgctgggaaaactggctagccaaatgtagaaagctgaaactggattccttccttataccttatacaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaacttgacaaatgggatctaattaaactagagagcttctgcacagcaaaagaaactaccatcagagtgaacaggcaacctacagaataggagaaaatttttacaatctatccatctgacaaagggctaattaatccacaatctacaaagaacttcaacaaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcagtaaacaacaggtgctggagaggatgtggagaaataggaacacttttacactgttggtgggactataaactatttcaaccattgtggaagacagtgtggcaattcctcaaggatttagaactagaaataccatttgacccagccatcccatcactgggtatatacccaaagtattataaatcatgctactataaagacacatgcacatgtatgtttactgcagcactattcacaatagcaaagacttgtaaccaacccaaatgtccaacaatgatagactggattaagaaaatgtggcacatatacaccatggaataccttgcagccataaaaaaggatgagttcatgtcctttgtagggacatggatgaagctgcaaaccatcattctgagcaaactatcacaaggacagaaaaccaaacaccacatgctctcattcatagtgggaattgaacaatgagaacacttgggcacaggatggggaacatcacacactgggacctgtcatgaggttgggggctgggggagggatagcattaggagatatacctaatgtaaatgaggttaacgggtcaacgggtgcagcacaccaacatggcacatgtatacatatgtaacaaacctgcacgttgtgcacatgtaccctagaacttaaagtataacaaaaaaagggaaaaaataaaaaataaaaataaataaatatataaaactgttgggggcattagtcacatgaacagctgtcaaaaaaaatagtggttatctctgggagtgatgtttccaaccttcttcttacttatctatatattttaatgttggcatacagagactatctaaaaaaaaaaaaaaaaaaaaaaaaagaagcagttgcttcaaaacttacaccagtgagaaattccacagaaaagctgagaacattcctaacaagggtccctttatgtatgcacttaacataacatatggaaattatttagttttctgcctcactaaagtggcctcccacaaaataggaactatagtctcactctcaatttctttttttattcctaatgcctattacactgtgtggcataatagcaggctgagggccaggcacggtggctcatgcctgtaattccagcactttggaaggccgaggcaggtggatggcctgaggttgggagttcaagaccagcctgaccaacatggagaaagcttgtctctactaaaagtacaaaattagccaggcatggtggcacatgcctgtaatcccagctacctgggagactgaggcaggagaatctcttgaacccaggaggcagaggttgcggtgagccgagatagtaccattgcattccagcctgggcaacaagagcgaaactccgtctcaaaaaaaaaaaaatagcaggctgaaggaataacttttcacagagaacccaaaagactctctaagaaaccaaaggtttagattctgtacagaaaacccagagaatcacctaggaaatagccaagactagccacagaatctctcactaaatacaaatttcatttaaccagctcagataaaaaaaatcctggtattttcctgcacctcccccttctgtctcccaatccattaacaaatccaactgaagaaatcctcttgtttctacatgtaaaatgtgttctcacaaccattctcaccatttcactgccaccatgcttgtccaagccagaagtcatctcttgcccatacatagaccagcaatagtcccctggttggtctccaggcttccactctcctgcactgtagccttcacacaacagagtgacctttaaaaaggcaaatctaatcatgctactctaagctcaaagcctccaataacttcccatcacatgtagaataaaagccaaagtgtttcctatggctcacagcctttcatgatgtgccctagactttgaactcctctcctaccctctggttcccaggtctccagccacactggcctgctgactattcctgaaacttgtcaagctcgttcctgcctcagggcctctatcctccccactcctgtgtttttcctctttgctggaaatgcacttctccttaaaagtgaccttttcaaacaggtctttttgtttagaagtcaccttatcaaaatacctatcttgaaccactttttaaaaaatagcaatgctttccaaccagccttcactgtctcttcctttaacctgctcaatttttcttcagtgtgccacctgccttacattatttattaatttggtatatatgtctatctcctccattagaatgtccattagggaaaggactttgttttctttaccactcgatttcaagtacttagaatagtgcctgccacattagaggtacaaaataaatatgagataattaactaggtgaatagataaataaatgaatgatatcaccaagatatgtttcaagttcttacacaaacacaatatttggcccagtgtctactataaacggtagaatatttcctcaagtcaacaccaaaaagggatgttataataaagcaggtcggacaacagtctcacattactgaataacgatactgatctgatgttgatgattgcttctttactttttttcttttttttttttttttgagagagggtgtcactctgttgcccaggttggagtacagatcacggctcactgcagcctcaacctcctgggctcaaacgatcctcccacctcagcctccctcgtagctaggaccacaggtgtacgccaccacgcccagttaattttttaattttttgtagagacagggtctcgccagttgcccagactggtctaaactccacctacctctgcctcccaagtgctgggattataggcatgagccactgtgcccagcctgatgattattttcaacaggccttgtgtttcctaagccccaaaagccttcccatttctcattccactgccatttgagacccatggccacctgattgaaacctcaaggttttgctaagaatttatgaagagagttaagaaatctcttcaaattgttcctatgaggaagttatttcatactatgagcaaattcattttcattaagtatctgttgtaaccaaacgttgtttcttagcttcttagctctgtaatatggcacaataatctgacttactgaagccactcattatttcccattggcttaattctttctttcttttttttttttttttagagatagaatctctctatgttggccatgctggtcttgaactcttggcctcaagaaattttcccacctcggcctcatagactctttctatgttggccatgctggtcttgaactcctggactcaagggatcctcctaccttggcctcccaaagctctcacgtaccagcacccattggcttaattatttcagtaaaatcaggcaaggaggaaccctacaaaataaacacaggcattctcaaagcagatataagtgaaaactcagagtatactgtggtcagctgtgttctctatcacaagtagtttgtcaacttaaaataaagtactaaagtttgggaatgatctactctaaaaatacatcggacaatggtcaatgtcatttacaacattcacctcctttctgatacacatctcaggaaaaaaaaaaaaaaactactaagtaccaggtcagaaatttggcacaaccctagatgaccaccttgtcatgcaaataaacttagaatggtgctcctgaaagtcagccacagtgcttcaaaaacacatgattttttaaaacaccaaactaagcataccacatagtatagagaccaggctatggagttgagaccacctgggttagaattccatttctttccatttagttgctgtcaccttcctaatttctctgtgttccatagttccatattatccataaaattcagatatgaacacttactatacagagttgttatgaggattggacaatgtatgcatcccacaagtagatcaattacaagtacattttgccccaagtaaagacaacacgtgggaacgctgtgcaagagggaacagcaaaagcagttggaggatggaagtcagtttgcaaacctatgcgcacaggcagccaaacacgaaaacgttccccacaagtagtctgtaaattggagactccattgggatacacacacacacacacacacacacgccctgagaggaaatagcacctttcttcatcaccaagttagccttaaaaattatttacccgttgttagccacactagcactgacaaacccaactttactcttgtaggtcattctccacaacgtctgtgctgcgtcaatcccaaatctgactccctgacgcttaacagcgaaaataaaaaaccgagacattactcaatagagttaacccttacttaacaaaacgctgttgtcccctgtggcgtgcagacagtagagacagtaattcccgaccttatgcttgtcagtgacggcatgccctttgtatacacgcttcagtagagaacgactgcagtaagtaaactgctagtagcaacactgttcccctatctaaacttcccctttccagagttactgatgtcccaacatgggtcggtcgctcagtctccgtcaagcccgtaccccatagcttgggcatttccccccgcagatcacaagatgcaaaggggaagttactaccaaaccgacgagaatggcccagagctgggggctgccaggcggttcctgggcccctctcagcaccagaagaaggcgggcgcaggctcgccgcgggtcggccgcacgccatacctggatcaggccctgctggaacaaggcgctgtgcacgcagccagggaccgccccgggcagctccagcgagccgttcccattgcagatgctccagttgccacgcaagctgtaactgagctccgcggcggtggtgcctgcaccgcacagcgcgagcagcaggagcaggtggaggcgcatcttgagatcccgcgccaccgagatgtggagagatcgaaaggcagcgctgcaagggaccggcggtgaagccactcaccccctcggaagtagccgaggcttt

SEQ ID NO: 2105 - DNA, 130350 bp, Homo sapiens
taaatttaaagcccattttattttgggtggaggctaacatgttattagtgtctttgtcacatttatacactacctttctcaatttgaccatagctgcctaaaaattgctttctgtttctagagggtatataggacaggactggtaaataggagaatggggtcctagactggcaccatgatggtctcacactaatcttttacctcaggaaatggaattaagaatattcatccacagaggtatagggtgagcttatgaaacttgaagtggcggaggcagatttggaattcctgcgagagcagccattgaaacttgggtctcttggcgttgctcttttcttccgactggacctggtggtgtctgcatcgttggggtcaaacacgactgtcatggactccattctggtcacggtgtacatactgctttgccggtttggatgaaacctggtggtcttgagctctagctcatcatagctggaaactttgatgaaaggacaccagcgaaatgctctcttgaagccagctcgaaatctgaggaaaagcaggccacagaaagaaaaagttattttttcaagcagatatgtctttcagctgccacagaaaattctacctaaggcagttataacaactcagtttttgagtttggtttttagccagactcttagaatttatgtcacagtactgttgttagtcgtttagttcttgtttgaattgaatcttaatttcccattaatgagaagcattgattcccagcaatgaaaagcatctcattcccatcagtgagaagtcatcaatagcgaatgcatagcatcaggtaatcaatatgttaaagaaacagtacatttttctaaaataattgtatacatttacataaatataattgaattaggctggccagttaaggcacttaaaaatgatatatttcaaaatagtttctttcagaaatgattacacatttataaattaaagtctcgtttaatgttagaattgctaatcttgatgatttttatctaattatatatgaaagtgcaaaatccttaactttgtaaaccattaaatgaagttaattaaaagtggatgtaatgcttgtggggtgtcaggaattgagatatggcttatgcaattagtgaaaaaaaaagcaagagttaattaagtatttaacaaacttaaggcacagtgtggtagaaccccaactgagaagagagcttaggatttaattcatgcagttacttacataaagtcccaattctacttgtgaaaaaaacacattggtttattacaggacttacgagccctatgaaatttaaccctatcccttcatgtgctgaccagtacaaccaaggtgtttttatctggaaagcagattttatcttttttttctagtcttacatttgactacaaatattctcacttttcattttttaactttataaacatctttcccttgaccactgtgatttcttcacaagccatctccatagaggctgcatgctctcttactcaccccacctcacaatgcaggaaggaggattggagttcccattgtttttacaaaaccttctacttcaaagtttatttatttacaacatatcctttttaataaagtccgctcacatatgccatcatctctccatcttatagaaattattcaagaatttctaggaagtaacttcatttcattgaggatttgagcatattttcaattctcctttaatcatgagggcacttctttttctttggcaggtaaaattctgagattttggaggaagaagttggcccatagaagaatcatccagttagaaccccaagatcattatttggggcatctaattattaatgtgggatgctttataaagtgtgtatgggggtcttgaaagataaagcctgtgcctctctcagtgaattcttaaattttcccttccttctgcattttgaatttgaaccaagaaaatggaacaacattgtatgtttccagtgaaggtgggtgtgacaagcaacttgcatttcgtagttttgtttttaccttttattcagacagcagtagatgatgggattgtacatggttgagctcattgccagccaaaagctagccaggtagacctgctggatgtatttccatctatttagttgttgatagattgcagtgagaatgaagtaaatatgatagggcagccagcagatagcaaatgtcatgacaacaataatcatcattttgacaacctataaagaaaaaaagtcatttttgacaaatataatactcataatagttccaatagcttattgcaaatcatgcttttctgccaatacagttaaatacacatcatgcctagggaatagtcaatatattaaaaaatggtgaagcaatatacggacagttgcctaaggtaagtctcaagaaattatgctatgtcactattcatttctacctatctaagtgaatgggtagtgctaactcaaacacggacaaatatattttgattggcctgaagaaaatcagtgtttacaaaaacccagagagcctggaacagagagagataggaactaggatgtggctgtgtagcctgcattgtacgatagtggagatattatctccaggaaatcaactgttaagtcactatggaggtttactaggctgctagggctgggtttgttcaagtcagtactcttctatagcctgactatagcttaagactatttagatttctttaatagcctgctcactacgtaaccttatgaatattaatttggtttctcttataatctgatattggggaagatttccccaaatagtgattatgtgtaaatattcacgttagtgtgaggaaaatactaacttgagatttgcaaatagattattggtttatgcaactgttttatgcattagcttttatgactttggtaagcataagccatttcctttgattgtatacttgtgaatgataatatcctggacagctctaatcaaagtagaatgtcagctgttatttctcttccactaggcctaaaattcctgaagacagaatgtcttaattatctttttactcccagcatctatcacagtccttgatatatagctggagataaatatatataggatgaatgaataataaatagcaatgtacaatgaacaatgttcatatctcttttgggaatttggaaatagtaaaaagtttaaaataagatactttaagctaaacaattttgaagcttacctgcagtcagattaaaacaaatcagggaaagctctgatgtaaagggcctatgaggcacctcagaactaggaagatacagtatttatgaaatggacttgtcatttgactgcaaattagggattcagatgaaggttggcaaggtttagtcaggagagacatgattttagaaataggcaaagcatgaaatggatcaatgtggaaggtaactcttccctaagggccaaatcactgtaccatccaggtggccagcattgagcagatggaaattggccatcagagttgaaaatccaggtcaacagctcacaaaatgtcatcactggccacatcacataatatcttttgattttcccagtgttctttaaattacattgctttcttctgaagaactgcttttgtatttctgcattttatttctcagatttcctattcataattcatatatttgtgaaaaacaaatgatttaatttacatttatgcaatattttacgtatttaacaattaattaattgtctttcaattgcgcattaggaaattgaggcaaaaacccaaagatctgaccactgtgattcatgtaactaagatctttcttgtctttttaccctctatttacagataaaaacatctgttgaatatcttgagtctagaaaataacattgaaaatatagtggttgaggaccaattcctcatcctgaagtttacaatgtaatgaaaaaaaggaaatgtataattttaataaaaatgcatgcattgaaatgtggtgagtatgaacatgtgcagataaaatttaaaataatatttatgagaatgtactagtttattgtaataaagaatgactcaatacatgcctactaactgtaggctcagaggatattagactaaatgaaattagtctactgatgttttcattgttgaatttgtgagcattctactattccttgaacagggtagttaagctccagccatagattattttccctggctcctccctctacctagaacactcttctaaccatgattcccagggcttaagtacctcacctccttcaagccgttgcacaattgtcattttttctttgagtgctattctgaccaattaatttaaaatcacagtctgcccttccagccctcccagaacctcttagcttgctctttctcttcagtttgttatgttttttctttattttgtgtctcctgatgctggactacaaaagagcaaggattttctgtttgttttgttcatttgtatatttcgggcacctagactggacttcatacataaagggtactcagaaattttttaaatgaacaggtgaaagtgactataaaacaaaagaaactgaaagacgcagacagttaagtaatgtctaagattttagtcagttattactagtatcatttggttttcatttaagatggacatgtgtatgtaaaataagcatggaatttactgctatttctgctttcaaggcaaacaaatttaaaaagagaatgagtccaaaaataacctttttttttttttgagacagagtctcactcttgtcacccaggctggagtgcagtggtgcgatcttggctcactgcaacctctgcctcccgggttcaagtaattcttctgcctcagcctcccaagtagctgggattacaggagcgtgccaccacgcctggctaatttttgtatttttagtagagacagggtgttaccatagtggccaggcttgtctcaaactcctgaccttgtagatccacccacctcggcctcccaaaattctgggattacaggtgtgagacactgcacccggcctaatataattattttcatggggcacatgaaagcattagatttcattctaagcaaatgttaagagcaagtaaaatatctttgagaatgttaacatatattgtatttgaatcttttatacagactgactacaaactccctatgcacaaaattgttttccgacaattgctgaaaacctactaaggctatcagtccttttagataaatttcaattttcatagtgcaaaaagttcagaaaaacatgcaaaaattaaaatgcatgtggaaaatggaacagagacttcagatagcttttaactcacatacagagggcctttagaacttcttgcgaaagatttataaacatattttaaaaattttaagaaaagcttaaaatactctacagaaatgtttataagtgaaacagctgctataatatattttctgtacttatttctatataatactgttaccttggcactctgcttacaaaatcttgtagtgttatttcagatgatgaactctctggactctagttttgatgtgaatgcaaacgtaggctcttgggtgggagaaattgtcttgctttgtgaaatgctgaaatcacaaaactgaaatcaccctcctgataaaatgccaaagaaaagagctctttgaagcatgaagcttgagcaatgatagatgtgcaggtgctatgagcagttaccactgtattgcatggctgaacaatggtactagtgcaggcaggctatgaactgttaaacagaaaaaagaatcaggtggtaaactttaagaaattcttgagatttttaggcaagatgacaatctgggacagagaaggttcaaatctctcatcgtgtcttaataatgttattaagtgggtagccacccattacccttggaaacttacaagcaggataaaggaggaaagtggggacatgtaatgtagcccttacaaagttacattgcctatttttagcagttaagaatctaactacgtaggcaggatggaactgcatgtcctcatatattagtgagaatgaactttggataccattccttcatgtatcaaaggggaaagatcttagatttttgtataccgtacagattagaactgaaatgcctacagttgttcttattcattacattaaattagtgtaggatggatgattttgaggtttgggttgtaaaagcaaaaattagtttaggaaattaactaaaatgctgacaactatttagaaaactctaggggtcatattcttttttttttaattttggcaatattatcttctaattattttatttttattattatactttaagttttagggtacatgtgcacaatgtgcaggttagttacatatgtatacatgtgccatgctggtgtgctgcacccactaactcatcatctagcattaggtatatctcccaatgctatccctcccccctccccccaccccacaacagtccccagagtgtgatgttccccttcctgtgtccatatgttctcattgttcaatacccacctatgagtgagaatatgtggtgtttggttttttgttcttgtgatagtttactgagaatgatgatttccaatttcatccatgtccctacaaaggacatgaactcatccttttttatggctgcatagtattccatggtgtatatgtgtcacgttttcttaatccagtctatcattgttggacatttggggtggttccaagtctttgctattgtgaatagtgccgcaataaacatacgtgtgcatgtgtctttatagcagcataatttataatcctttgggtatatacccagtaatgggatggctgggtcaaatggtatttctagttctacatccctgaggaatcgccacactgacttccacaatggttgaactagtttacagtcccaccaacagtgtaaaagtgttcctatttctccacatcctctccagcacctgttgtttcctgactttttaaagattgccattctaactggtgtgagacgatatctcattgtggttttggtttgcatttgtctgttggtacaggattgattctttctaaatgcttggaataaaaatggtcagctaggtgtgacaaaaaacaaaacaaaacaaaactgcttgttttgattagaatcctttttttaaaattttattattattatactttaagttttagggtacatgtgcacaatgtgcaggtttgttacatatggatacatgtcccatgttggtctgctgcacccattaactcgtcatttacattaggtatatctcctaatgctatccctcccccgtccccctaccccacaagagtccccagtgtgtgatgttccccttcctgtgtccatgtgttctcattgttcaattcccacctgtgagtgagaacatgcagtttggttttttgtccttgcgatagtttgctgagaatgatggtttccagcttcatccatgtccctacaaaggacacgaactcatcattttttatggctgcatagtattccatggtgtatatgtgccacattttcttaatccagtctatcattgttggacatttgggttggttccaagtctttgctattgtgaatagtgccgcaataaacacatgtgtgcatgcgtctttatagcagcataatttataatcctttgggtatatacccagtaatgggaaggctgggtcaaatggtatttctagttctagttccctgaggaattgccacactgacttccacaatggttgaactagtttacagtcccaccaacagtgtaaaagtgttcctatttctccacatcctctccagcacctgttgtttcctgactttttaaagattgccattctaactggtgtgagatgatatctcattgtggttttggtttgcatttctctgttggtacaagattgattctttctaaatgcttggaataaaaatggtcagcttggtgtgacaaaaaacaaaacacaacaaaactgcttgttttgattagaatccttttttttaaattttattattattatactttaagttttagggtacaagtgcacaacgtgcaggtttgttacatatgtatacatgtgccatgttggtctgctgcacccattaactcgtcatttacattaggtacatctcctaatgctatccctcccccgtccccccaccccacaagagtccccagtgtgtgatgttccccttcctgtgtccatgtgttctcattgttcaattcccacctgtgagtgagaacatgcagtttggttttttgtccttgtaatagtttgctgagaatgatggtttccagtttcatccatgtccctacaaaggacatgaactcatcataatttatggctgcatagtattccatggtgtatatgtgccacattttcttaattcagtctattgtttttggacatttaagttggttccaagtctttgctattgtgaatagtgccgctataaacatacgtgtgcatgtgtctttataacagcatgatttataatcctttggggatatacccagtaatgggatggctaggtcaaatggtatttctagttctagatccctgaggaatcgccacaccgacttccacagtggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggtgagcattttttcatgtgtttttcggctgcataaatgtcttcttttgagaagtgtctgttcatatccttcgcccactttttgatgaggttgtttgtttttttcttgtaaatttgtttgagttcattttagattctggatattagccctttgtcagataagtaggttgcaaaaactttctcccattctgtaggttgcctgttcactctgatggtagtttcttttgctgtgcagaagctctttagattacttagatcccatttgtcaattttggcttttgttgccattgcttttggtgtgttagacatgaagtccttgcccatgcctatgtactgaatggtattgcctatgttttcttctagggtttttatggttttaggtctaacatgtaagtctttaatccatcttgaattgatttttatataaggtgtaaggaagggatccagtttcagctttctacatatggctagccagttttcccagcaccattgattaaatagggaatcctttccccatttcttgtttttgtcaggtttgtcaaagatcagatatttgtagatatgcggcattatttctgagggctctgttctgttccattggtctatatatctgtttgtgcaccagtaccatgctgttttggttactgtagccttgtagtatagtttgaagtcaggtagcatgatgcctccagctttgttcttttggcttaggactgacttggtgatgcaggctcttttttggttccatatgaactttaaagtagtttttcccagttctgtgaagaaagtcattggtagcttgatggggatggcattgaatctgtaaattaccttgggcagtatggccattttcacaatattgattcttcctacccatgaacatggaatgttcttccatttgtttgtatcctcttttatttcactgagcagtggtttgtagttctccttgaagagctccttcatatcccttgtaagttggattcctaggtattttattttctttgaagcaattgtgaatgggagttcactcatgatttggctctctgtttgtctgttattggtgtataagaatgcttgtggtttttgtacattgattttgtatcctgagactttgctgaagttgcttatcagcttgaggagattttgggctgagacaatggggttttctagatacacaatcatgtcatctgcaaacagagacaatttgacttcctcttttcctaattgaataccctttattcccttctcctgtctgattgccctggccagaacttccaacactatgttgaataggagtggtgagagagggcatccttgtcttgtgccagttttcaaaaggaatgcttccagtttttgcccattcagtatgatattggctgtgggtttgtcatagatagctcttattattttgagatacgtcccatcaatacctaatttattgagattttttagcatgaagtgctgttgaattttgtcaaaggccttttctgcatctattgagatagtcatgtgctttttgtcattggttctgtttatatgctggattagatttgttgatttgcgtatgtcgaaccagccttgcatcccagggatgaagcccccttgatcatggtggataaactttttgatgtgctgctggattcggtttgccagtattttattgaggatttttgcatcaatgttcatcaaggatattggtctaaaattctcttttttggttgtgtctctgctgggctttggtatcaggatgatgctggcctcataaaatgagttagggaggattccctctttttctattgattggaatagtttcagaaggaatggtatcagctcctctttgtaactctggtagaattcggctgtgaatccatctggtcctggactttttttggttggtaagctattgattattacctcaatttcacagcctgttattggtctattcagagattcaacttcttcctggtttagtcttgggagggtgtatgtgtcaaggaatttatccatttcttctagattttctagtttatttgcatagaggtatttatagtatcctctgatggtagtttgtattcctgtgggatcagtgttgatatcccctttatcattttttattgggtctatttgattcttctctcttttcttctttattagtcttgctagcagtctatcaatcaattttgttgctctcttcaaaaaaccagctcctggattcattaatcttttgaagggttttttgtgtctctatttccttcagttctgctctgatcttagttatttcttgccttctgctagcttttgaatgtgtttgatcttgcttttctagttcttttaattgtgatgttagggtgtcaattttagatctttcttgctttctcttgtgggcatttagtgctataaatttccctctgcacactgctttgaatgtgtcccagagattctggtatattgtgtctttgttctcattggtttcaaagaacatctttatttctgccttcatttcattatttacccagtagtcattcaggagccggttgttcattttccatgtagttgagcagttttgagtgagtttcttaatcctgagttctagtttgattgcactgtggtctgagagacagtttgttataatttctgttcttttacatttgctgaggagtgctttacttccaactatgtggtcagttttggagtaggtgtggtgtggtgctgaaaagaatgcatattttgttgatttggggtggagatttctgtaggtgtctatcaggtcagctttgtgcagagctgagttcaattcttgggtatctttgttaactttctctcgttgatctgtctaatgttgacagtgggatgttaaagtctcccattattattgtgtggagtctaagtctctttgttggtcgctaaggacttgctttatgaatctgggtgctcctgtattgggtgtatatatatttaggatagttagctcttcttgttgaattgatccctttaccattatgtaatggcctttttttgttttccatttgcttggtagattttcctccatccctttattttgagcctatgtgtgtctctgcatgtgagatgggtttcctgaatacagcacactgatgggtcttgacgctatccaatttgccagtctgagtcttttaattggagaatttagcccatttacatttaaagttaatattattttgtgtgaatttgatcctgtcattatgatgttagctggttattttgctcgatatttgatgcagtttcttcctagccttgatggtctttgcaatttggcatgtttttgcaatggctggtactggttgttcctttccatgtttagtgcttccttcaggagctcttttagggcaggcctggtggtgacaaaatctctcagcattagcttgtctgtagaggatattatttctccttcacttatgaagcttagtttggctggatatgaaattctgggatgaaaattcttttctttaaaaatgttgaatattggtctccactctcttctggcttgtagagtttctgctgagagatcaggtgttagtctgatgggcttccctttgtgggtaacctgacctttctctctggctgcgcttaacattttttccttcatttccactttggtgaatctgacaattatgtgtcttttagttgctattcttgaggagtatctttgtggtgttctctgtatatcctgagtttgaatgttggcctgctttgctagattggggaagttctcctagatagtatcctgcagagtgttttccaacttggttccaatctccccgtcactttcaggtacaccaatcagacgtagatttggtcttttcacatagtcccatatttcttggaggctttgttcatttctttttattcttttttctctaaacttctcttctcccttcatttcattcatttcatcttccatcactgataccctttcttccagttgatcgcatcggctactgaggcttctgcattcgtcacgtagctctcgtgccttggttttcagctccatcatgtcctttaaggacttctctgcattggttattctagttatccatttgtctaattttttttcaaagctttgaacttctttgccattggtttgaatttctcctgtagcttggagtagtttgattgtctgaagccttcttctctcaactcctctaagtcattctccatccagctgtgttccgttgctggtgaggagctgtgttcctttggaggaggagaggtgctctgctttttagagtttccagtttttctgctcttttttttttttcccatctttgtggttttatccacctttgatctttgatgatggtgacgtacagatgggtttttgatgtggatgtcctttctgtttgttagttttccttctaacagacaggaccctcagctgcaggtctgttggagtttgcctagaggtccactgcagaccctgtttgcctgggtatcagcagcagtggctgcagaacagcggatattggtgaaccgcagatgctgctgtctgatcgttcctgtggaagttttgtctcagaggagtaccaggccatgtgaggtgttagtccagccctactggagggtgcctcccatttaggctactcgggggtcagggagccacttaaggaggcagtctgcccattctcagatctcaagctgcatgctgggagcaccactactctcttcaaagctgtcagagagggacatttaagtctgcagaggttactgctgtctttttgtttgtctgtgccctacaccaagaggtggagcctacagaggcaggcaggcctccttgagctgtggtgggctctgcccagttcgagcttcctgtctgctttgtttacctaatcatacaactaactcagcaatggcaggtgcccctcccccagcctcgctgccaccttgcagtttgatctcggactgctgtgctagcaatgagcaagactccatgggcgtaggaccctcctagccatgtgcgggatataatctcctggtgtgccattttttaagcccattggaaaagcgaaatattagggtgggagtgacccgattttccaggtgctgcctgtcactgctttctttgactaggaaagggaattcccttaccccttgcacttcccgggtgaggttatgcctcgccctgctttggctcgtgcacggtgcgctgcacccactgtcttgcacctactgtctggcactccccagtgagatgaacccggtacctcagttggaaatgtagaaatcacccgtcttctgcgttgctcacgctgggcgaacttatccttttttatggcggcatagtattccatggtgtatatgtgccatattttctttatccagtctatcattgatgggcatttgggttggttccaagactttgctattgtgaacagtgctgcaataaacatacgtgtgcatgtgtctttatagtagaatgatttataatcctttgggtatatacccagtaatgggattgctgggtcaaatggaatttctggttctagatctttgaggaattgccacactgtcttctacaaaggttgaactaatttatattcccaccaacagtgtgaaagcattcctatttctccacatcctctccagcaactgttgtttcctgactttttaatgatcaccgaactacaaaccactgctcaaggaaataagagaagacacaaacggaaaaacattccatgctcatggataggaagaatcagtatcttgaaaatggccatactgcccaaagtaatttatagattcaatgctatccccatcaactaccattgactttcttcacagaattagaaaaaactattttaaatttcatatgggaccaaaaaggagcccatatctccaagacaatcctaagctaaaagaacaaagccggaggcatcaggctgcttgacttcaaattatactgcaaggctatagtaaccaaaacaccatggtactggtaccaaaacagatatacaaaccaatgcaacagaacagaggcctcagaaataacaccacacatctacaaccatctgatctttgacaaacctgacaaaaacaatcaatggggaaaggattccctatttaataaatggtgctgggaaaactggctagccatatgcagaaaactgaaactggatcccttccttacaccttatacaaaaattaattcaagatggattaaagaattaaacataagaccgaaaaccataaaaaccctagaagaaaacctaggcaacaccattcaggatgtagacatgagaaaagacttcatgattaaaacaccaaaagcaatggcaacaaaagccaaaattgacaaatgggatctaaattaaactaaagagcttctgcacagcaaaagaaactaccatgagtgaacaggcaacttatagaatgggagaatttttttgcaatgtatccatctgacaaagggctaatatccagaatctacaaagaatttaaacaaatttacaagaaaaaaaacaccaccatcaaaaagtgggcaaaggatatgaagagacacttctcaaaacaagacagttatgtggccaacaaacatatgaaagaaagctcatcatcactggtcattagagagataataattcttttttttttctttttattattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgtggtgtttggcttttttttgcgatagtttactgagaatgatgatttccaatttcatccatgtccctacaaaggacatgaactcatcattttttatggctgcatagtattccatggtgtatatgtgccacagtttcttaatccagtctatcattgttggacatttgggttggttccaagtctttgctattgtgaataatgcggcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaactgttcctatttctccacatcctctccagcacctgttgtttcctgactttttaatgattgccattctaactggtgtgagatagtatctcattgtggttttgatttgcatttctctgatggccagtgatgatgaacattttttcatgtgttttttggctgcataaatgtcttcttttgagaagtgtctgttcatgtccttcacccacttttcgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtctttggttgccatggcttttggtgttttagacatgaagtccttgcccatgcctatgtactgaatggtaatgcctaggttttcttctagggtttttatggttttaggtcgtacgtttaagtctttaatccatcttgaattaatttttgtataaggtgtaaggaagggatccagtttcagctttctacatatggctagccagttttcccagcaccattgattaaatagggaatcctttccccatttcttgtttttgtcaggtttgtcaaagatcagatagttgtagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcagtggtagttggatggggatggcattgaatctgtaaattaccttgggcagtatggccattttcacaatattgattcttcctatccatgagcatggactgttcttccatttgtttgtatcctcttttatttcactgagcagtggtttgtagttctccttgaagagctccttcatatcccttgtaagttggattcctaggtattttattttctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttccttctccggcctaattgccctgtccagaacttccaacactatgttgaataggagtgttgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttggcttcatccctgggatgcaaggctggttcaatatacgcaaatcaataaatgtaatccagcatataaacagagccaaggacaaaaaccacatgattatctcaagagataataattcttaattagacttagcaaatcatacttatcttttgtaacagatatgcggtattgttaagcatgtttttgtttcttttagtccatatcattgcctatgcattattcattttgtgcccctagaaattagcatagtttttgagttttgaattttgaaggtatcttttgacttttgaaggtatctgattttcagactcagtttatgaacatttgaattgcaggaagcattatgtatttatttttatcttaccagtgtttagtgttattatgctcataataagaattcaaaaatattatttaaaataaataaaacaaaaatacttttaaatattttatatttaaattaaaataatctttattgctcttagtttttgtctctagcaggctggatgtttggaaagaatagctatttgagccatgtgataatataggcttaagaaagaaatacagttgtttttgtgtacttaatctattgtatacttagattgaacatatagagaatattgacttcaaatatacattttagatgatatttaatgccatgggaatgaatgaaattactcagagaatagagagtgagaagtggtctagattaagccccaaataagtcagacattttgaagtcagtcagatagagacaaagggctggaaaggatatcaggaacaagcagtgtttggcaagaaaactgctataacgtggtcagaaacatcactacagggttttcctctcctttaggagggattgccagtcctgtagaatgttgctcaaagttttagtaagataagaaatgatcgtttccatggagactagtggttgaactgaaccagagtacctgtggtggaattgtgcagtcaaaatctaaatggaaaggtttaaagtgtgaatgaaatattattggatacatacctaaaagaaaataaatcattctatcaaaatgacacacgcactcatatgttcgttaccacgctattcacaatagcaaaggcatgggattaacctaggtgctcatcgataatagattggataaagaaaatgtggttcatatacaccatgggaaactacatagccataaaagtataaaatcatgtcctttgcagcaacatggatgcagctggaggccataatcctcaatgaattaaaaccgaaatagaaaacgagataccacttgttctcacttataagtggaagctaaacattaagcacgcatggacataaaagtaggaacaatagatactgtagactactagaggcaggagaaaggggagcataggtggaaaaactacctattgggtcctgtgctcactacctgggtgatagaatccagaccccaaatctcagcatcacactatatacccatgaaacaaatttgcacatgtaccccgtgaatctgaaataaaaaaagaattatggatgttttcattggttataatggagggacatagattggaagctgggtggaggatcaaaagataattttctaaaattaaacatactgaaaggtgtttgaatgctattggaataagcctataggtcgccaagtacaaccgaaggcttatgctttctaacagagtatgagcaaatggattctgcaaactttggggaggtggacatttcttcattgtaataaaaaggtatgattgtagagagtatatcaaatggatttgtaagtaagttacatggtcagaaatctaatttcatctattgtctcctagtttcttaataactagtgctcagtgtgcctacaaacaaggtagcacatagaacattctgaataaatatttgtaaaatcaataaattaatagagcctgaggcaatgtcattagctaaatagatgaggaattaatttgattagaaaacagtgtattcttccctaaatcatacatatttcatataaaattgaaagtgctcagaaattgggctgcctctagggtggccaaaaatatgaagtgtgtaatagggaactacacagtgtaatgaatatcatagcacaggcttcattatgctgtggaattattagtgataagctactaatagaaaaagatagatatttgttggccttattcactgcattctatttcaacagtggccacaaaattatttccatacacaaatgtttttgtaggatgtaatattgtgttagtgtgatttatttacaccctaaagcaaatataattcaaaatatatgttatagaagctcttgctgtcttccctcaatatcagcaatgcaaaaagaaagaaactgctttttattataagaaataactcaaaaaggagcaacataaaagtacatttggtcttttatttttatgttttattttgtttataattaacagataatggttgtacattatttgtggggtagtgtgtttcaatacatatataatgaaatgatcaaatcagggtaaacagaatacttatctcaaacatttgtcatttctttgtagtgagaacattcaaaatcctttcttttagctattttgaagtgtacaatacattattgttgactatagacaacctactgtgtaatagaacatggtaacttattcttcctatcgaactgtaaatttgtacctggtgaccaacctctccccatcccctctcctgccactctcctcagcctctggtaaccactattctactagtgattagtgagaagtaaccactcacttcttctataaggtaaactttgttagattctacatatgactgaaatcttgtggtgtttgttcctctgtggttggcttaacataatgtcctctaggttcatggaaactgttacaaatcataaaaaataattttttatgactaactagcattgtattgcgtatataaccatattttctttaaccatgcatctcttggtggacacttaggttgattccacttcttggctattgtgattagtgctgcaataaatataggagtgcaggtatctcttcaacatgctaatttcattgcttttgagtatgtaccttgtaatggaattgctggactatgtggtagttctgtttttaattttttgaggaacttccatgttattatccataaaggctgtactagtttacagtttgtccctccaatagtgtataagagttctttttcctgtgcacctttgccagcatttgttattttttgtctttttcataatagccattctaactgggatgagattatatctcattgtgattctaatttgtgtttctctaataattagtgatgttgagcattgtttttcatatacctgttagtcctttgtatgtcttcttttgggaaatgtctactcagatcctttatccatttttaaattttattattactattatttttgctattgagttgtttgagttccttatatagtctggatattaactacttgtcagaggcatagtttgcaaatattttctccaattctgtagattgtcccttcactctgttgattatttcctttgctgtacaaaagctttttagtttgtcatcatcttatttgcctatttttgcttttatttctcttgcttttgaggtcttattcaaaatatccttgtccagatcaatgtcataaagcatttccccataaatttgtctagtagtttcatagttttgggtcttacatttatatctttaatccattttgagttgatttttgtaagtgttgaaaaacagaggtctagttccatccatctgcatatgcataaccagttttcctagccccatttaggggcttgtcctttccccaatgtgtgttcttggtgcatttgttaaaaatcagtcgggtgtaaagtgtggatttatttctgggttctctaatctgttccatcggtatatgtgtctgtttttaggctagtatcatgctgctttcactatttttgtttttagtatattttaaggtcgggtagtgtaatgcctccagctttgtcctttttgttcaagcttgctttagctattcagggtcttttataatttcatgaaaattttaggattgtttttcctatttctgtgaacactttcattggtattctgatagggattgaattgaatttgtaaattgttttgggtagtatggatattttagcaatattaattcttccagtccaagaagatgggatatttttccacttattagtgtcctctttagttgcttttgttaatgtttcatagtttttattgtagagatcttccatctcctcggttaagtttagtcctagttactttatttttttgtagctattgtaagtgggattgatttcttaatttcttttttagagagtttgctgttggtgataattaataactaattaacaccttaaagagcaaaagtaaggtacacacagttgcctcctaaggcagagggggagtaaaatttgttggagaccttttatgtgcaaggctctgtgccacatgcattacctcttttgaactaatgcaatctgtacatattggaggtgccagctaattatgtttcaattatagttaaactgtctagtagacaagcatttccttttttttaacacagacatggcatcaagaagtagaggagaatgattctggagcaaaaggccaataaaaaagtttacttttttgcccctctaaaagctacattcttcttgtgaacatccacacctcagtaagtgtcatcatcatctatctgactgccagagacagacacttataagtcatggttgtttctttggttttcctcattttcactgccccattcaatcacttggcaaatcctattgaccaagacatcaaaataagtcttatatcttttaatatcttgtcatctctactactataacctctgagaaagcattgttgtctctctcctaaacaaatgcgataaccatctaattggcctctgcttccaaatagcagatacagtaactttttaaaaaatgtaaaatagattaccctctacttaaaataattttcttattgtatctgaaataaaactgaacattcaaagcttctgttatattttgctgccgtgttctccagtctcacccattacatactcccattggttctttatgccccaacatcctgacttctttctgatccttaaaaacatcaataattttcctacttcaggcattgcttatgttgtctttcttgcctggagtgctcttctcctaattctttgtgtgctttatttgttcttattgataagaactcagctagaatatcactccaacagtcatttcctaccaccctagttgaaaacaactccgattgcaattattctctttcatggcttatttccttcagcttttccagtgtaatttgttactctcttgtttatttaggggttatctttgccctgcttaaatgcaaatcccatgaagttcttttttttttttcttgtggttattttttgagacagcctcgctctgtcacccaggctggagtgcagtggcttgctcttggctcactgcaacctccgcctggttcaagtgattcttgtgccttagccttctgagtacctgggactacaggtgtgcaccaccacaccagctaatttttgtgttttttagtagagattgggatctcgccatgttggccaggttggtctcaaactcctgacctcaggtgatctgcccaccttggcctcccaaagtgctgggattacaggcgtgagccacagagcctggcctgggaagctgtgttttgcatttctctctctctccagtgcttagaagaatacccagagcacatgataaccctcttttaaataaatgaataaatgaatatataaatagatgaatggtacaaagtgaaagattggtattctcatacatggtttggagttgtgatgccctagataaaaaacagcttaaacatcatatgggcttctgagagagtgttataaagtttccctttagagtctctttctatattgcaaatctaattaataatatacggatagttttgtaatgtgcaaaaatggtcaatatactagttatattttagctgtcgtatatagtgctggtgaaaataagtctttgtataggcaaagtgcttactttttagtataataacataggcgttgtgattaaaaagaaggactaagagccaggtgataagaattctagtcccaaccttgctagtaaatatctgtgtgataaagcctcagctttctcacatacctataaaatgaggctaacctcataaggttgtgtgaaaattatttaaaataatgcttttaagcattacttagggaaaactgccatcttgctcactgcaacctctgccttccaggttcaagcgattctcctgcctcaacttcccgagtagctgggattacaggtgtgcgctaccacgcccggctaattttttttttttttgtactattggtggagacggggtttcactatattggccaggctggtcttgatctcctgaccttgtgatctgcccaccttggcctccccaagtgctgggattataggcatgagccaccgtgcaagactaatattgtattttaatagctggtaataaaatgaaaattgtcttagcttagactgtcataacaacatatagattgggtggcttaaacaacagacatttattttctcacagttctttaggctgagagtctaagatcagggtgccagcatggttacattttggtgaaggcttccttcctggcttgtaggtggctaccacctcactatgtgctcacattacctctttttttttggtacaggaggagagggagtggagaaggggagaaagagagagaaagagtgaggcagagacagaaagagaatgaatgagtgagaactctggcatctcctcttatagggatactcattctattgtataaggatcccatttttatgtccttatttaactttacctccttatagacctcatttacacacacggttataatgggtgttatggctttaacatatgaattttggtgatgtacaatttagtccttagcaaaaataaatttaagatatattctcaaatgttcatttatgaatgtttagttctattactttctagactttccctttgagttctaattttccagtacaactaaaacaaatatcaagaacaagacatttagtctttttctttctctctctggtaatcatcataatagttttttaataggaaagctattcaaggaatatctatcatcttgttattttgtggaaatatgctatgttggagaagtagtaaagccaaaaaactgacagatttttttttccttgatattctaaggtctaggttttattaacttggttccatttagtgttgaggcaaaggctttaaatgaatcattaaatggttgagcagtggtatatgtttaagctcatgctcttcatggaatggttacagtcaaacctttcagtcttcattgcacagtagtgtactgcagtgctaagagcattaaagttacaaaatttgatttaaatctagactacgttagtatattggatatagtaagaatattgatgttcagaaagattaagtaatttgcccaaggacacaatagtcttattagtgaagaagagatgagaacactcatcactcaggggattatgaagactaaatgaaaatgtgaatgccaaactcaacatactctgggcttgatattcattcaatattcaatattcagtaagatattcatttttacttcattttcatgatcttgctaatttataatcatattttaaatcattagcactataacctaagttgattatgaatgtgttttttttttttttttttttttttttttgagacagagtcttgctctgtcacccagtctggagtgcagtggcgcgatctccgctcactgcaagctccgcctcccaggttcatgccattctcctgcctcagcctcctgagtaactgggactacaggcgcccgccatcacgcctggctaatttttttgtattttttagtagagacagggtttcactgtgttagccaggatggtctcgatctcctgacctcgtgatccgcccacctcggcctcccaaagtgctgggattacaggcgtgagccaccgcgcccgtcctatgaatgtatttgtaaaggcaagagaagaccatggtcgtgagctgagggaccatgggtaacatgaagaccgagtactggagggccaaatacttctgtcaaatttcataatagcaagtatgcagctagtaggagttaaagcagttaaaacagctcttccttttaccatatttcctgctatcgtgtgtgtgtgtgtgtgtgtgtgagagagagagagagagagagagagagagagagggaaatgggtttgttttgggaagtggcatcagattcatgtttctcattgcaacttaaaaaatagcaagcctaattgttggatagttataatggctttactacttctccaacatagcatatttccacaaaataacaagatgatagatattccttgaatagctttcctattaaaaaactattgtgatgattaccagagaaagaaaaagactaaatgtcttgttcttgatatttgttttagttgtactggaaaattagaaaaataaaacttaataaaatatgtttcacaatgaaaagacaatatatgttcttaaacagtaaaaaagtacacagactctaatggcaatttaattcttaactgtaatatatagagcataaaattaaccaaggcatgaaatctcggtatatttttttgtttgtatttaagatttcaatttgtactggctcataaatttcatctgagataaaggaaaacagcttgtctatatatctactcctttagatcataaatattttctgagaaagagtaatatcctctgctttgacaattccggaaatacattttataacagtgcattcaaatgtttcccataatatgtcagaaaaactgcagatgttgtggaaaattcaatgttatggattcatacaggtcagtaatgtcagaaattcatgacctgtgctagaggaaactcctagacaggatagtgaagaatgcaaagttttaagtgaaacattaatacaagtttgtgggttactacacagcacagaacagacaaccaaagaaaaaaagacaggacatattattataaagatgtttccaatataagaattttagggattctggctcccaataatggcagagtacatacgtgtatgtgtgtgtgtgtgtgtttgtgtatcacaaatgtacagagcatatacataaataacatatggagtatatagtatatatagtattgtacaatgtaaagagtagcatgtatatttatctctctatagacacacacatatacattatacttgtgcatatatatgtatgcatgtatttgtatgtatacatttgagtcccaccaaactagagaaaaatcctcagtaaaaactgttttcagtagaaaccctaattttcccaggtgtatgcttaaatgctatgcctaaaattaaaagattaaaagattatcctaaaaccaagggcaaaactaaaatagatttccctaacaaaatataaaaccaaatctcagccaggcgcagtggctcacgcctgtaatttcagaccttcgggaggtcaaggcagataggtctcttgagcctaggagtttgagaccagcctgagcaacatagtacaaccctgtctctaccaaaaaatacaaaaattagcggggcatggtggcatgtgcttgtagtcccagctactcaggaggctgaggtgggcatgtcgattaagcccaggaggtccaggttgcagtgagccatgatcaggccactgcactatcacctggtaaacagagcaagaccttatttcaaaataatattaaatttaaaagaattaaaaaacccagacctccacaaatctgagatgacccaccagtaattttaactgacttacaggagaaagcatagaatttttcagatgaagatatgatccagactcttaatatgctacttcacaatgttcactaagcaacaaaaaattatgagacatgtgaataaatagaaaaatgtaatccatagtcaagaaacaaaatgagcaaatatatttcacaattagcagggaagacctttaaataagtacgataaacatattaaggtatctacagaaaaagttagttataatgagttaaaaaatcgagaatttcaggagagatataaaaagtatttaaagaaagagagaagcaaatgcaaatcttagaataatatcttaaatcaatacaaaacatttcattttaatcatgattatgtaaatacttgataaaaagtacttgataatacttgattcattttgttactatctcaaatctttttccaagactatagctctagaataaaacatttgttttcatcattactagaagaaaaaaattaattttgggggacttctaagcaaaatctttctattgttaagttcccattaattgctgctgtttctggtcagagtctattctttttagcaactcataaacataagaattggtgtatgctgcctcatcaaaagtggaaaccagacttggaatatcaaaatgattcattatcgtttaatgtttatttgagtcataaatattagaagatcataattcatttgagtcatggtttaagaaaaacaagcaagaaaatgtatagcaaactgatttattttgaaatattctaccctccatattaaatgtaaactttcatatataatgattattttttaagtaatgacttaaatagaggaatgaacttaactagtatcattttgaaagaatatgtgtttatcaggcacctgggggaaggtaattaggagagaaaaaaatatcaccagatgtcatgatgcttgtagatagagaaaataaaattgatgggagaaaaatcataaaatatcctaaaaattcagtgtctatgagtttaggaaaaatattttttcactggcttttagtcatcctttgagggcatttgtcatcagaaaaaataattctatttgtgtttttgttgcaattgctttggggaacttagccataaattctttgccaaggtcgatgttgagaagagtacttcctagattgtcttccacgatgtttataatttgaggtcctacattgaaagctttaatccattttaagttaatttttgtatatggtgaaaggtaggagtccagcttcaatcttctgcatatggctagctagttatcctagcaccatttgttgaatagggaatcctttctctgtggcttgtttttgtcagtcttgacaaagttcagatggttggttgtaggtgtgtggcttatttctgagttttctgttctcttccattggtctaggtgtctgcttttgtaccagtgccaaactgttttggttactgtggctttatagcatagtttgaagtcgggtggtatgatgcctctggatttgttctttttgcttaggattgctttggtgacttgggctttttttttttttttttttttttttttgttccatatgaattttagactagtttttctagttctgtgaggaatgacaggtagtttgataggaatagcactgaatctgtaaattgctttgggaagtgtgaccatttttacgatattgaattcctccaatccatgagcatgagatgctttttatttatttgtgtcctctctgatttctttcagcagtgttttgtagttctccttgtaaagatcttccacctccttggtcagttgtatttgtaggcattttatttttttgtggctattgtaagtgagatggtgcttttgatttatctctcagcctggaatgctggtatatagaaatgctattgatttttgtacgttgattttgtatcctgaaattttactaaagttgtttatcaattctaggagccttttggcagagtctttaggatatttcacgtagagaataatgccatctgcaaagagagatagtttgacttcttttcctatttggatgcttttcatttctttctctgaaagttgctgaaagtgtttatcaattttaggagtctttgagcagagactatagggttttctaggtatacaatcatatcatctgtgaagagagatagcgtgacttcctattttttttttgacggagtctcactctgtcacccaggctggagttcagtggcacgatctcaactcactgcaagctctgcctccagggttcaagcaattctcctgccccagcctcctgagtagctgggattgcagacacctgccaccacgcctggctaatttttgtatttttagtagagacagggtttcaccatgttggccaggctggtcttgaactcctgacctcaagtgatctgcccacctcagcctcccaaattgctgagattacaggcatgagccactgcacctggccactatttagatggcttttatttccttcttttgcctgactgctctggctgagacttccagtactatgttgaataggagtggtgagagtcggcatccttgtcttgtttcaggtctcaaggagaatggtttgagcttttgcccattcaatatgatgttggttgtgggtccgttacagatggctcttattattttgaggtgtattcctttgaactctagtatgttgagggtttttatcatgaagaaattttggatttttatcaaaaggtttttctgcatttattgacatgacaatatgatttgtgctattgattctggttgtgtggtgaatcacaattatcaacttgcagatattgaaacagccctgtattccaggaatgtctccaaagtaacaaaaacttgctaagttgataagtgggacctaattaaaataaagagtttctgcacagcaaacaaaaactatcaacagagcaaacagacaacctacagaatggaggatattcacaaactatgtacctgacaaatgtctgatatctggaatctatagggaacttaaatcaacaagcaaaaaaaaaaaccttattttaaaaatgggcaaagaacatgaacagacatttttcaaaacaagacatacaagtggccaacaaacatataaaaaatgctcagcatcactagttgtcagagaaatgcaaattaaagccacaatgagatatcatcttacaccagtcagaatggcttttattaaacagtcaaaaagcaacagatgctggtgaggttgtggagaaaagggaacactgttggggggcttaaacactattggtaggaacataaattagcatgaccgctatggaaatcagtccagagatttctcaaagaacttaaaatagagctgctattcaacccagcattcccattactgggtacaccaaagaaaataaatcattctacctaaaagacacatacgttcatcactgcatattcattcacaatagcaaagacatgtgatcaaccctggtacccattaatgatagagtacaatttaaaaaatgcccatatacaccttgaaatactatgcagccataaaaaagagggaaatcatgtcctttgcagggacatggatgatcccggaggtcgttatcctaaacaaactaatgcaggaatagaaaaccaaataccacatgttcttgcatataagtaggagctaaacattgagcacacatggacataaatatgggaacaatacacatcgtggactactggagggtgggggtggatttaaaaaactacccattgagcactatgctcacacctgggggatgtggattcatactccagacatcaacttcacacaatattcctatacaacaaatctacacatgtacttgtctctaaaataaaagttaaattttaaaaaataaagattccaaggaaacagattcattcattaatcttataagcatttataccattcttgaattatgtaccttgtgagttgttgaatatctaatgctaaggcatagaccctgctcttcagtttggtaaaatttcttggaacagatagctaaacaaaagaacattacttatataatgttgtatgccacatgctagagttttccatgtggtattgtggaagctcaatgtgaaacactgaggaagtggagatattgaagagtccttctagaagaatagctgtctgtgatgagagcaattgaaaagcagtgggggaaagcagggacgagtcttctgatcacagaaaataaggtaaccaaaactcatgcctccttctagtattacgaatagtttcgctgagtgggatgtaccatgtactacaaggtatgctgatgaagaagctgggagataaggatggagatgagaatagagggccaatatgtgtttacaggtcagagaaaccattaaagaattttaataagggtattcataaattcagattttagatactttgaagacagtttagaatggacttcatttgagtggaatataagataggcaggaggctttttataaattcagacaaagaattaggtagttctaaacaagaatggagaaaaggcttaggaaagaagaaaataactatatgagtacatttagagttaatttgaaggtccttgtcattcattgaacattgattaaggaaagggaaaagttatagattatttccagattttttgtctggaccactgtacagatattaagaatattctataaaatggaaacaggcatttcagagcaaaaattattatttagtttttaccagcttactttgaagcgtctactacacataggtttggagtgagaggtggttaataaaattttaatctcaagctcagggcctaaacctagagaaatctagatatgggcataatacaaatgtagatttgaaagtaatttttaagggtgttgatatcctgggagatgagattatccaaatgagatcctaaatgaaagtataaaaatataaagaatgggactttgggtaaagagtagcatttaagtggttgttagaagaagaaaagccaaaaaagtctactgaagaggaatggtctgcagagagaaaggacaccaatgccatggacagggagacttctcgaagggggagtgatcaaagggtgtctgttccttcagtctagccaaggactgaatacatccaatgaatttaggaacaaagaagtcaaaggtaactttggcaagggtggtttcagtggaatggtgtgttggaagccacagcgaattaatcaaaggtgtaaaagattgataagagaagcaggcaaagagatgtgagcatacttacattttgaagagagaacatggtgaagtaaaataggtcatggttcagaagacagatggtttcattgacggaggactactcttgagaaggaagtgccaaggatacagaatattggtaatgagtggatgaaggacatgaaaagatagaaatcagtgaaaggccaggcacggtggctcacgcctgcaatcccagcagtttgggaggctgaggcaggcggatcacaaggtcaggagatcgagaccatcctggctaacacagtgaaaccccgtctctactaaaaatacaaaattagccaggcgtggcagcgtgtgcctgtagtcccagctgctggggaggctgaggcaggagaatggcgtgaacccgggaagcggagcttgcagtgagccgagaggcttgatgaggtgttcagagtgagtctagccaaaaatatgtggccaattgaacctccaacccccacataaaaaagaatccaaaattcaatactaggaattattcaggtaccagagaagaactgcattgctgtggagttatggagctcagtagcaagcagctatcagacccagaggagactaatgtcaaggtggttggataagggcattcacccaattttaagaaactacacttccaaaaataaaataaaatgcatgttaaagttctactcaaaatgaatcagagggcaaaatttaaaagatgaaaatgccacgaggtcatttcctggatctacctgtcctccaactggagtatacctacctaatgtatttaaaataatgtacaaatttaaataacaaagtctttaaaatatatatttatcttaaatcctcctcttcacaggaggatttaagatacattattttaaatattgtattatttaaatcttcctgtgaagaagatttaaaataaatacattaatgctttatacatgtatttaaaatttatacaaataaaactataaacttttttccactcaactattgtaatctggtactttagttggatcaaaatatatttgcaaagctatatatttcagagagaagagaatctgatttatgctgctaaatcatgcaaagatagacaccctgggatttttctctatttttttttaattaacaacttcatatgctggaaaatagttttctgcttattttatggcaaaatttattttggcttgtaatcatagactataacagccatgtttgtgccatataaaaatttgataacatgactatagcaaaacgtatctgaactatatgtcccattttaggttatgagacttaaggagggtgtgggttaaatcctttatttttgaatcacttgcccaagactgcctaaatcctaggcagtcttataggaagaccagagagcaatagaaactgaattttaaggcatagggtctcccattcaatgtattacaagtgatccctaaataaatgtaagttgatttacttattgcctcacagtactggattcagaggtctctatgcatagtccttcttgcaaaaatttcttgcttggtaatgaaattttctaggagatgctccaggaaatctcacagctagaaggtagactcgttttcggatgatggagacctggcttatattctgaataatgtaaataaaacagtgacttctagttctccagggtattttgttttaaagtaaaacacactaccttgttcaatctaggttaactgtggcatatcaacctttcactatcactcatcagtttttaatttctaatgagaaactttatatgaagagaattatttcatacttgattgtctgccttttaatccacacgggtaacatttgaaggacccgttgcttattctaattaatatttgagttcctattccctttaggtatgcaattactgttttctgtgttgttctcatgtcttttatgatgctgtttttctttgcagatttagtatacaaagcatgtatgttcctttagggtgttagcaaaaataattttccttgtctgggcttagatggtgcagcaagaggctttagaaattcctgttgcagagatttatataagactgccacatcttactggagaatgatgaaataatgaagcagaaataatctgaagataatacctgagaatcaaaagggataaagtaatcacagtgcattattccactagttctaaatgttttcaaataaaaaaagattaaagacaggcttgagaggcatacaaatgatttcgacaaagccataaatttgaaaatatgctgagtaaagtatataggtgtatagaaaatcatagcactttggaatttacaacttaagcaaagtagtagaagaaagtctccccgaaatctttgttgaaatgaaatacaaatgaaaatagtattagaaagaaatctgaagagatttacagcatgtaattggaattacagaaataaagcatttgtgtaacatggtttgtaagacaaaacattatttttctatttgtaattcccttttgacttgaaggagagtgaaatgtgggtacatggagaatattttgttttttctgaatagggtaacagatgtgggtaggtatttggaagtttggaatcatttgaattataggaagagggctacagtttgaattgtcagaacaattctaaatttgtctttaaaaagtgtgggtgaatggtctttctggatcagagaaatggatcaagggggagcagcaagacagggaaaggtagagagggagaagaaaagagagaaggagattaaaaaagagagaaacacgcaattgcctcagaactgacttcagaagaaatgttgaaaggaattttatgccgtgagagacaaattatccttttggactcatctacaaaatcctcagtaaatttacatttttcattaaggacatatgaaaaaattaaaaaagttatatacatggaggctgctaaaatctggtttacataggcaatgataaatgaaaacaatattactgggaattgaatggtataaaacgtgtaaggactatgagacatttacagagtgctctcttggtgggaagtaggtgttgtgctaggcacattaaaaacttggtcccttgttacaaagattatgtacaaatgaaaaggtgaaataattttgaaatgaactgtttcctgtaaggcaaggatagacaaaagagaagtagaaatgcaagggaaagtggaaaaaaaactgccaagtagggatgaacaaaaggagtaaaatattcaagtcaggccagcagaaaaatactttcctcaattttctttcagctaaagaataaacgagttagaatgatatgggagtagggggtggggggttgtaattctacctttatttagtagcactctcacttgccatgaaacctgtatcttcatattagagcagaattcatccttggtgccaggaagctcccggaatctatgaggtgacttggatcaaagagatcaatatctaaagactttaaataacctctgtgttatctgctgaactatgtcctcctaaaatttttttgttgaagtcctaacccccagtaccttacactgtgacagaatttgaagatagggcctttaaagaggcaattcaggtaaaatgagatcatacacctggtctgtaatccaaaaataactgtgcttttatcagaagagattaggacacagacctgaagggaaggccacatgaagatcccagagggatggagccttttacaagccaaggagagaggcctcgggaaaaatcaacccagcctacattttgatcttggacttctagcctccaagacagtggaaaaataaatgtctatagtttaagccacccagtctgtgatactttgttatggcagctctaacaaactatcatttttacctttccctccctatcacctcatcaccctctaaatcatatgggacagatgtgaactgacgtttgtattgttattcaacctaggtagatccatgttgagtcatatacatgtgtaatttacataggtgcttctgtggctgaaattactaatctaatctggtatcttttaccaattacatccatcagagagagcctggtcatatgtcacctctggatcttagctgtcaaccaaaaggacgctaagacaaaaaagcctgtcctttatgtgggcttttattattattgttatttttttttgacgaatttttgtgtttaggaaaaagacgtatagctggtgtaaccagctaagggcctggggcagaatgggaggcttgcaggaatgtgtgtcggttagcaaatatgccatggagatttgcaacacttaagcctgcgtgtagtccttgctattcatcattctgttaactgcacctctctagtaattattttacatggccaggtaatttatatttgatgttgataaatatagtcctacaaaacattgaagtagttttctccggtatgaaagaaagcaggcattgtgtttgttgttgttttcagtatagtttaaggttaagggaatttgtaactttataatgagtaataaatgcatggtataatttctttttactgattagaatttttagtttactgcatactgtatcagtaatctatataatataaagtttccaaaggtccctatgtattgttttaattgtggtggggccgagcgcggtagctcacacccgttatcccagcactttgggagattgaggtgggcggatcacgaggccaggagttggagaccagcctggccaacatagcaaaaccccatctctgtgaaaaataaataaaaaaaaaaaattagctgggcgtggtggcaggcacctgtagtcccagctccttgggaggctgaggcaggagaatcacttgaactcaggaggcggaggttgccgtgagccgagatcatgccattgcattccagcccaagtgacggtgtgagactccgtctcaaaaaaaaaaaaaaaaaaaaaaaaaaaaagtctaggtattaaagttgtgctaattcttccttggtggttcatacctgtaatcccagcactttgagaagccagggtgatggatcacctgaggtcaggagtacgagaccagtctggccaacatggtgaaactgtgtttccattaaaaaaaaaaaaaaaaaaaaaaaaagctgggcatggtggtgtgcacctataatcctagctactcagaaggctgaggcatgagaatcacttgaacctgggcggcagaggtagcagtgagccaagactgctccacggcactccagcctgggcgatagagcaagactcggtcaaaaaaataaataaataaataaatttttaaaaaaagtcttggtaaagggatcaattcatcaagaagagctaactatcctaaatatatatgcacccaatacaggagcacccagattcataaagcaagtccttagagacctacaaagagacttagactgccacacaataataatgggaaactttaacaccccactgtcaatattagacagatcaacaagacagaaggttaacaaggatatccaggacttgaactcagctctccaccaagcggacctaatagacatctgcataactctccacccccatatcaacagaatatacattcttcttagaaccacatcacacttattctaaaactgaccacatgattggaagtaaagcactcctcagcaaacgtaaaagaacagaaatcacaacaaactgtctctcagaccacagtgcaatcaaatcagaactcaggattaagaaactcactcaaaactgcacaacttcatggaaactgaacaacttgctcccgaatgactactgggtaaacaataaaatgaaggcagaaataaaaatgttcgttgaaactaatgagaaaaaagacacaaggtaccagaatctctgggacacatttgaagcagtgtgtagagggaaatttacagcactaaatgcccacaagagaaagcaggaaagacctaaaatcaacaccctaacattacaattaaaagaaccagagaagcaagagcaaacacattcaaaagctagcagaaggcaagaaatcactaagatcagagcagacctgaaggagatagagacacaaaaaacccttcaaaaaatcaatgaatccaggagctggttttttgaaaagatcaacaaaattgatgatagactgctagcaagactaataaagaagaaaagggagaggaatcaaatatacacaataaaaaatgataaaggggatatcaccactgatcccacagaaatacaaactaccatcagagaatactataaacaactctacacaaataaactagaaaatctagaagaaatggataaattcctggacacatacaccctcccaacactaaaccaggaagaagtcaaatctctgaatagaccaataacaggctctgaaattgaggcaataattaatagcccaccaaccaaaaaaatccaggaccagatagattcacagctgaattctaccagaggtacaaggaggagctggtaccattccttgtgaaactattccaatcaatagaaaaagagggaatcctccctaactcattttatgaggcaagcatcatcctgataccaaagcctggcagagataaaaagaattttagatcaatatccctgatgaacatcaatgcaaaaatcctcaataaaatactgacaaactgaatccagcagcacatcaaaaagcttaaccaccacaatcaagtcagcttcatccctgggatgcaaggctggttcaacagacacaaatcaataaatgtaatccatcgtatacacagaaccaatgacaaaaaccacatgattatctcaacagatgcacaaaaggcctttgacaaaattcaacagcccttcatgctaaaaactctcaataaactaggtattgatggaatgtatctcaaaataatcagagctatttatgacaaacccacagccaatatcatactgaatgggcaaaaactggaagcattccctttgaaaactggcacaagacaaggatgccctctctcaacactcctattcaacatagtgttggaagttctggacagggcaatcaggcaggagaaagaaataaagggtattcaattaggaaaagaggaagccaaattgtccctgttttcagatgacatgattgtatatctagaaaaccccattgtctcagcccaaaatctcctcaagctgataagcaacttcagcaaagtctcaggatacaaaatcaatgtgcaaaaatcacaagcattcttatacaccaatagcagacaaacagagatccaaatcatgagtgaactcccattcacaattgctacaaagagaataaaatacctgggaatccaacttacaagggatgtggaggacctcttcaaggagaactacaaaccactgctcaatgaaataaaagagtacacaaacaaatggaagaacattccatgctcatgggtaggaagaattaatatcgtgaaaatggccatactgcccaaggtaatttacagattcaatgccatccccatcaagctaccaatgactttcttcacagaattggaataaactactttatagttcatatggaaccaaaaaagagcccacattgccaagacaatcctaagcaaaacaaaaaaaaaacaaaaaaaaaacaaaaaaaacaacaacaacaacaaaaaaaaacaaagctggaggcatcacgctacttgacttcaaactatactacaaggctaccatagccaaaacagcatggtactggtaccaaaacagagatatagaccaatggtacagaatagagccctcagaaataacaccgcacatctacaaccatctgttctttgacaaacctgacaaaaacaagaaatggagaaaggattccctatttaataaatggtgctggggaaactggctgccctatgaagaaaactgaaactggatcccttccttacaccttatacaaaaattaattcaaatggattaaagacttaaatgttagacctaaaaccataaaaaccctagaataaaacctaggcaataccattcaggacataggcatgggcaaggacttcatgaataaaacaccaaaagcaatggcaacaaaagccaaaattgacaaatgggatctaattaaactaaagagcttctgtacagcaaaagaaactaccatcagagtgaataggcaacttacagagtgtgagaaaatctttgcaatctacctatctaacaaacggctaatatccagaatctacaaagaactcaaatttacaagaataaaacaaccccatcaaaaagtgggcaagggatatgaacagacacttctcaaaagaagacatttatgcagccaacagacacatgaaaaaatgctcatcatcactggtcatcagagaaatgcaaatcacaaccacaatgagataccatctcatggcagttagaatggtgatcgttaaaaagtcaggaaacaacagatgctggaggagatgtggagaaatgggaatgcttttacactgttggtgggagtgtaaattagttcaaccattgtggaagacagtgtggtgattcctcaagtatctagaactagaaaaaccattgacccagccatcccattactgggtatatacccaaaggattataaatcatgctactataaagacacacacacacgtgtgtttatcgtggcactattcacaatagcaaagacttggaaccaacccaaatgtccatcaatgatagactggattaagaaaatgtggcacatatacacatggaatacaatgcagccataaaaagatgagttcatgtcctttgcagggacatggatgaagctggaaaccatcattctcagcaaactatcacaaggaccaaaaaccaaacacggcatgttctcactcataggtgggaattgaacgatgagaacactgggacacagggcagggaacatcacacatgggggcctgtcggggtgtgggtggctggaggagggatagcacttggagaaatacctaatgtaaatgacgagttgatgagtgcagcaaaccaacatgatacatgtatacctgtgtatcaacactgcacgttgcacacatgtaccctagaacttaaagtataataaaaaaatgaataataaatgcatggtatagttcctttttactgattagaatttttggtttactgcatactatatcaataatgtatataataaaaagcttcctatgtattattttacttatggcagagcacataaatatttattaaaatatttagtgagctatggaaactttccagaaaagtttaattcatttagcagtaagatgaataggccttactttcagtcctgagggaattaatatagtcctgaaaacatgaactttgtctggaagattcagattataatctttcctttgtgtgttgggactgagctgagtaccgtgttggaaattaggaagcctaaagtccacaattggctctccctgtttataacaattctgaccttaagcaagtcacatcacatgactgtagattctctcatctataaaatgagaaggtagttgattcacaaaactccatccatctggcattatgctaggcactgagaagacaatggtgagtaaagcactgctcttgatcagtgttctttaatagagcctagaatttgcttgtgataaaatactttcctttttctaaccaagtatcatttcaattcaacctatttttgatttatcttgttctttcctctattttttaagtctaatagctgtgcgagcttattgttacatggggtctaattgtaaactaaagaatcatacatggttattacataatgttattatttactaaagtgaatactccaaatattcacaaatagcctagttaaaactatttaactgtatattaaaaacaactcaatcaagataaaatagggaaacatggacaacatttagaaatgcgcattcgtcttaggagagggaaaagacaataatgtttgtgtgaatttggcttaccagatgagacagaaaacattgaaacaaattctgatagaaatcttgtcattatacatggaaccaacccaaatgcccatcaatgataggctgaataaagaaaatgtggtacctatacctcctggaatactatgcagccacaaagagaaatgagatcatgtcctttgcagggacatggttgaagctggaagccatcatgctcagcaaactaacacaggaacagaaaatcaaacatcacatgatctctttcacttataagagagagttgaatattgagaacacatggacacaggaaggagaacaacatacagcagggtctgttggtgggtggggggtgaggggagggaacttagaggatgggtcaataggtgcagcaaaccaccatggcacacgtatacctaggtaacaaacctgcacgttctgcacatgtatcctgttttttttttttgaagaaataaagaaaaagaaatattgtcattttataaagtgcactgaaagctggatgaaagcttatgaagaaagaataaatcaatacattgaagagcaaagaccaatctatttccagaaaagtgaatctgtacagaaaggcagaagatcattttagcattaaatataaaatctaacagtgccttgtaaatgtagccacaatattcataatcaaagggggcaagataactctaagtgacatggacaacagaactagagggatataatttatagaaggaagaataaatttgttctcttaaaacttacatagtgagtacatattgtaaaaaaaagattaaaaagtgttagtatgatgatattattatattattaattattttcctgacatctttttgtccctcttactgacattaactacaatgcagttcctagaccttagtgttagactgggttccaaactagattcctctgctttctggacacaccctctaagccttagttatatcatcagatagctaactataataataccttttagtgttgatgacactactaaatgagataatgtatgtgactaacaatgcttaaatatgtggtcttattataattaaaagtaatttactaaataaagaaatattgagcatctgaaagaaatgcatgtagattttgtaatcctaagggctaaatgaataaagtaacagagccccatgaggtagcttatttgctgcaaatcaatttattttattattattttaaattttatttttccataagttattggggtacaggtggtatttggttacataagtaaattctttagtggagatttgtgagaccctggtgcacccatcacccaagcagtatacactgcaccctatttgttgtcctgatccctcaaccctcccactcttccccacaagtccccaaagtccactgtaccatttttatgactttgtgtcctcatagcttagctcccacaatcagtgagaacataaaatgtttggttttccattcctgaattatttcacttagaataatagtctctaaccttatccaggtcattgcaatttaaatgagctaatttctattttcagttgaatcgtttaaaaaatagccaggtgttttcctgagcccattgtcttggggtttaattcctccataggtttgttgcatttgttctgttttatgaccacagatattcctaactttagttagttctttttttaaaaaaagcaagtctttcaaaatagaagctgaagaaagtacataaatatgagtcagaaccaatcgacctatcaccatgtgaaataagcacctagaaattcatcttctgctcacaaaaggtcggaagctaaaagattacacatggttataaatacaagctggttatacttctaatgcaaaactaaataggactagaaggcagatggcattaacccttttacttttgagagcacaaaaaccactgcatgaactgttagtcattaattcacttttttcccaaaggatattttattaatctgttattaacagtaacctctaatgaagaggaacaatgatatcaatggaattttctgcattgcttaaaaatctttcttttactgaattagaaataaaaacttcaaatgagataaatgtaaacagaagccaatagttctggcaaaatgatttttctcttctcgtctgacttggcctccaggaggttgggggaatgagattgggaggaagaaacataaacagtgagaagagaaatgtgtgctcatgatacccagtaggtggtgcagctatactagctataattttgctatttaaagggcatgatagaatgctgttctcttcatgaacatttataatcagagtaacagaatgcattgatatgaatctctgttcataaatgaccatcagttgtcatcttcatcagcataaactgtaaagtacctcttgctgcatatgaactatttcaccttgctggattttcctaaagtgaatttaacttcttcaacaattgctggattttcgcacagaaatttgtttctattttctgtcaatagcgtcctcattttcttagcaattaatcttaaaacagaactttttcacttccagtctctcagtatccatagctaatagagttacccaactctggtgattattttaaaaggttttcacatttatccctttccatttcacctttagtttctctagcttcaacttccttatttgcttatgcatctctcaagtaagataacaccttttctatctaatccagagcattgttgggagtgtaaaataaaataatgtgtaggctgtgctacaaaaggttttagagttgggaatttttttaatcaaagattctgagctagtttcagtctccatatagcttgcttgcctcaccatttgatgtgctgggtctgcgcatacaagtatattacctacattatatatgcacacatatatgcatatttatatgagtaatagagacaaaactactacatataaacatgacattgtactataagtatgatttaatactctcagtatcaatgatttatctcccactaaaacatttgcctaaatgtagatcaaagtgcatatattttttctttctgacaactagatagggctaagggttgaagaggaaggaatgaggtggaacaatgactgagattgaagagaaagaatatagcgactggagtcttatcaactgaaagaagaactttcatttttgaggggagaggtctccatgctaaactgaacttaggtgtgcatcttcccacccctacccctgtgcaaaacataacttgcagacaactcagagcctaatcatgaaggattcttctaagccttcccatgcttaatataaagtgggttgctttggtgacttgcttaacgtcaatggtgtgacggaaaactttggctctaaccaaaatcaagtgcacagaacccactaagaattttttgtgagcttagccaactaatatttatgcttgaaatataaacccttttgtaagatttaaataaaatcacttgtgcacaatgcctggtacacattagatgttgagtaaatatttgatgaatctcaatcattgatgtctataattggaagagaatttagaggtagctcttattattttatgaataagttaatgagcctagaaaacaatgatcctaccaacatattactgaatcagtaccagtctagcaaccagcagtcctgaatttcaattctctttccattgtattgtaaacttttcctttcttttgctttgtatcatcactctcctttctaacacagtctctctctctttctccccctccctcgtccttcttcctctctcataggcacacacaaaactttgtgctcatttggcttaagaatccagaatttctcaaaaataaacagctaaatttatgtaggtttactaaatttaacaatgtatttagagttgctttcattgcaataaaaccattaattactctcagtatgctttaggttaattaactaaggagaatttgttaagggagtttatgtattgttttagtatgtagcaaaaggagctgttgaatgctagaaaacaaacccatctgaactaaaaaacacaaaatactatgtattgagcagatatacaatttttaatcaatcaaaacacagattttacctcagtgcatctcactttggtaagtatgtgcagtcccagcttcatgagtttttttctgagaattaatttttaagttgactctggtacttagatgaattttgattgctgatattggaaaatattttcttctcagaaatgatgttatacattttggttggcttaccacacaaaagccttttatctcataatacgtaaataatacaataatacaattcagtggtactggtaacacattcaaaagctagcagaaggcaagaaataactaagatcagagcagaactgaaggaaatagagacacaaaaaacccttcaaaagattaatgaatccaggagctggttttttgaaaagatcaacaaaattgatagaccgctagcaagactaataaagaagaaaagagagaagaatcaaatagacgcaataaaaaatgataaaggggatatcatcaccaatcccacagaaatataaactaccatcagagaatactataaacacctgtatgcaaataaactagaaaatctagaagaaatggataaattcctcgacacatacatcctcccaatactaaaccaggaagaacttgaatctctgaatagaccaataacaggctctgaaattgtggcaataatcaatagcttaccaaccaaaaaaagtccaggaccagatggattcacagccgaattctaccagaggtacaaggaggagctggtaccattccttctgaaactattccaatcaatagcaaaagagggaatcctccctaactcattttatgagtccagcatcatcctgataccaaagccaggcagagacacaaccaaaaaagagaattttagaccaatatccttgatgaacatcgatgcaaaaatcctcaataaaatactggcaaactgaatccagcagcaaatcaaaaagcttatccaccatgatcaagtgggcttcatccctgggatgcaagactggttcaacatacccaaatcaataaatgtaatccagcatataaacagaaccaacgacaaaaaccacgtgattatctcaatagatgcaggaaaggcctttgacaaaattcagcaacccttcatgctaaaaactctcaataaattaggtattgatgggacgtatctcaaaataataagagctatctatgacaaacccacagccaatatcatactgaatgggcaaaaactggaagcattccctttgaaaactggcacaagacaaggatgccctctctcaccactcctattcaacatagtgttggaagttctggccagggcaatcaggcaggagaaggaaataaagggtattcagttaggaaaagaggaagtcaaattgtccctgtttgcagatgacatgaattgtatatctagaaaaccccattgtctcagcccaaaatctccttaagctgataagcaacttcagcagtctcaggatacaaaatcaatgtgcaaaaatcacaagcattcttatacaccaataacagacaaacagagagccaaatcatgagtgaactccctttcacaattgctacaaagagaataaaaaacctagggatccaacttaccagggatgtgaaggacctcttcaaggagaactacaaaccactgctcaatgaaataaaagggggatacaaacaaatggaagaatattccatgctcatgggtaggaagaatcaatatcataaaaaaggccatactgccaaaggtaatttacagattcaatgccatacccatgaagctaccaatgactttcttcacagaattggaaaaaactactttaaagttcatatggaaccaaaagagagcccacatcgccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacatatctacaactatctgatctttgacaaacctgacaaaaacaagaaatggggaaaggattccctatttaatcaatggtgctgggaaaactggctagccatatgtagaaagctgaaactggatcccttccttacaccttatacaaaaattaattcaagatggattaaagacttacatgttcgacctaaaaccataaaaaccctagaagaaaacctaggcgataccattcaggacataggcatgggcaaggacttcatgtctaaaacaccaaaagcaatggcaacaaaacccaaaattgacaaatgggatctaattaaaccaaaaagcttctacacagcaaaagaaactaccatcagagtgaacagacaacctacagaatgggagaaaatttttgcaacctacttatctgacaaagggctactatccagaatctacaatgaactcaaacaaatttacaagaaaaaacaaacaaccccatcaaaaagtgggcaaaggatatgaacagacacttctcaaaagaagacatttatgcagccaaaaaacacatgaaaaaatgctcatcatcactggccatcagagaaatgcaactcaaaaccacaatgagataccatctcacaccagttagaatggcgatcattaaaaagtcaggaaactacaggtgctggagaggatgtggggaaataggaacacttttacactgttggtgggactgtaaactagttcaaccattgtggaagtcggtgtggtgattcctcagggatctagagctagaaataccatttgacccagccatcccattactgggtatatacccaaaggattataaatcatgctgctataaagacacatgcacacgtatgtttattgcggcactattcacaatagcaaagacttggaactaacccaaatgtccaacaacgatagactggattaagaaactgtggcacatatacaccatggaatactatgcagccataaaaaaatgatgtgttcatgtcctttgtagtgacatggatgaaactggaaaccatcattctcagcaaactatcgccaggacaaaaaaccaaacactgcatgttctcactcataggtgggagttgaacaatgagaacacatggacacaggaaggggaacatcacacaccagggactgttgtggggtggggagaggggggagggatagcattggaagatatacctagtgctaaatgacgagttaatgggtgcagcacaccaacatggcacatgtatacatatgtaacaaacctgcacgttgtgcacatgtaccctaaaacttaaagtataataataaaataaaatgaaaaaaagaaaaatcagttgaccacaaaaaaatgtaaagaaatacttttatttattgtttccttcttaagtacagaaataatcagtataatacagagagaaagaacacattctctagaatcagactttctgggttcaaatcctgactctattgttaaataaaataggcaagttactcaacccttctagttacttctttatctgtaaaatgaaaataacagtgatgtcttccttatgcagttataaggattcaatgtctaatgtatctaaacaacctaagtaagctgtatggcacataataagcaccaatcaatgctagctgtgtttctagacctatcataagcattatcttttaattaataatcataattaggtttatatttgtttcatgaatagggcaaagtaagtgaagattggatttgcatatttatgagcattaggaactagagactttgacatatatattacctagattaaccctcatcaaaacattgcaagaaaaatattattttagtattttataaataagaaaatgaaaggtgagatatcaagatgtagtagaccagtaactggcaatgcaagaatcaaaccatgctgtctgactctgtagtttatgtttgtccccattataaaatattgcaaagatatgtatgtatatgtgctgtgttacacacaatatcataaatgcaagaaatttaaaaaggctttttttggcaaaggaaatcttacttgtggcaaaattcagttgaaataatcctaaccttgtaataagaatcaagaatagagaaaaaatgcacttccctaatgattagtgatgtagagagttttttttcacatatttgttggccatttgtatactttcatttgagaaatgtctgtttagttcttttgcccattttaaaatcaagttacttgttttcttgttgttggtttgtttgaattccttatgtattttggatactaacctcttataagatgtatggtttacaaattttttctcctaatccattcattgtatctttactctattgcaagcttgtccaacccgtggcccacaggctgcatgtggcccaggatggctttgaatgtggcccaacacaaattcataaatttttgtaaaacgttatgagatttttttttacgattttttttcttttagctcatcagctatcattagtgttagtatattttatgtgtggcccaagacaattctttttcttccagtgtggcacagggaagccaaaggattggacacccctgctctatagattgttttctttgccatgcagaagattttagtttaatgcaatcttgtttgtctattttgcttttgttgccagtgctttgaggctaaacccaaaaaaataattattcagacaaatgtcataaagctttccccttattttttcttctagtagttttatagtttcaaggcttacatttaagtatttaatccattttgagttgatttttatatactatgatttaagggttcaattttattcttctgcatgtgtatacccaaggtccctcaacacgatttattgcacatactgttctttttcaattatgtgttcttggtacctttgttaatatcaatttattgtaaatgtgtgggttcatttctgggctcactgttctgtttcattggcctaggtgttttttaaaaaaattccagtaccataccattttgattactatagttttgtaagatattttaaaataagatagtgtgatacctttagattgttcttttgatatatgaaaaaatgttcaacagtactaatcatgagggaaattcaaattaaaaccgcaatgatatattacctcacacctgttagaatggctatttaaaaaatggaagataagtgttggcaagaatgtggagaaaagggaacccttccttgtacactgttgttgggaatgtaaattagtacagccattgcgtaaaacagtatgaaggttactcagaaagctaaaaattaaacaagtattatctgattcagcaatctcacttctgtatacatacccaaaggaattgaaatgagtatatcaaaagatatctgcaattcccagtttattgcaacattattcacaatagccaagatatgtaatcaacctatgtatacatcagtggatgaatggataaaaaacgtggcatatacacacaatgaaatactagtcagcctttaaaaagaaggagattctgccatttgcaataacatggatgaacctgaaggacattatgctaagttatataagccaggcacagaaaggcaaatacttcataatctcacttacatgcataatctaaaaaatgtcaaactaatagaagtagagagtagaatggtggttaccagaggtgatgttgggagggaatgggagatgttgatcaaagggtacatttcagttagacaggtgatactataagttttcaaggtctactgaacagcatgatgactatagttaataacaatgtattgtgtattttgaaattgctaagagaataaatttcaaatgttctcacaacaaaaaaagataaatatgtgaggtgatggatatgttaattagcttgattccatcatccaaaaatatggatatacatatttatatatatatataatcacattgtatatatataatcacatcatatataatcacattgtacctcataagtgtataaaattattatttgtcaattttaaaaaggaagagaatacaattattatttgtcaattaaaaaatgagtaaaaatagaaaaaatgttgcttttttaaattggcaaattattattatttgtctattataaaaagaaaacatcaaatactgaagaaaacgtggtatatccacaagagaatattgtttcagccattaaaaaagaatgaaatcctgtcatttgcagcaacatagatggaactggaggacattatgctaagtgaaataagccaggcacagaaagacaaataatgcatgtactcactcatatgtgggaactatatgaaaattgatctcacggaagtacagagtagaacggtgattaccagaggctgggaagggtagggtggaggggagttaaggagaggttggttaatggatacgtacatacaggtagatataaggaatacattccagtgtttaataacagtagggtgactaggataaaatatgcaacagtaatttattgcatattttaaaatagctgtaagaaagatttggaatgctcccaacataaaggtataataatttttgagctgatggatatactaattaccctaattagattactatgtattgtgttcgtgtatcaaaatatcacatgtacccccaaaatatgtacaataattatgtatcaatatgaaatttcaaaaaggcaagtgaatttctatgtttgttaaaattaatggcactttctgattgtattcatgtcttactacattatcacaataaatgggagtaaacacaggttttgtaataactactggatttgctttattgtttttatgcctttttagagcagtgctgactaatatgatagccacttctacatgtggctatttaaatttaaacttacataactagaataaaataaaataaacttattcatttgtttgtattagccatacttcaagtgttaaatagctacctgtggttagtggctactgtgttggatagttcagatatggaacatttctatcattgaaaaactttttattggacagcactgttctagagtaaatcaggatgtagaatggaatgataagcaggaaatttcagtaggggggagattgccagtctggcgacagagtgagacattgtctaaaaaaaagagagagagagagagagagagagagatacagattgcctaagggtagctaccaattctttgcagttcaaagtagtagaaataacagttgttttgcattctgtaggaatgaactctacttgcactacctgtcagtttgggcaacattcaccttcccagagcttcagttttttgatttgttaaatgagggataacaatttctaccaggcctcacttccaggatttttgtgaggatgagtacaacgatatatgtcaaagctctatataatgattgtataaaatctataataattgatataattctcagttgtgtgtgtgcctgtgtgtatgtttcatgaagtattgataatgatggcaattgttatagatttcatatgctgagcttcattttcctgctagaaattcatgatgcctgaacatgattccatctctcctgaatttgtacttgcagaatgagtagtattaacagataacccatagagaacctttttcagatgattgccaaacactgaaaggctttagatatttcctcctaatgtttatcttttcttatctttttaaaaaagaataatcatttccacttcttcagtactactggaaaaccacaaaaaaaaataaaaacttttctaggcctttcaaagtgtttcacatttactgccacacatagagagcaggatttactgccacacatagagagcaggaggaatatttaatcaaagggtttaaagcatgtggtattggcaatcaatgtacaactcagatatagaaggctctcctgattgcaagtcgtaccatgaggtggggtagataaagttactagaattagcaaagagctattagttttctttaagcttcactgtttcaattagaaacagtagttgaattgtatacatggtaatattatacaagcccatcagaagtttcagatgttttctgactttgttttgtttttagctatttttcttttaagcaaaagcttttaaagaacaaattgcgtacattttcagcatacactgctgggttaaaatatttatataatttcagaatgatatgagatagatacagtctaatgatattcattgattcatcggtcaaaataaaaacttttctcaaaatatctgaatgaaaaataattggtaaataatcatgaatttctatataaaattcctacaatatttttcttttttgggaagatatttcataatacataacagaaatttaaaaatttttttctagttcctgactttcatttccctagaaaacttactattaaaatgttagttttataccaagatgataacatgcctttttaaaagaaagtagaatacattagtttttaaaaggagatattatggttttatgattaataataatatgaataacaatattattatgacaaattattaaggaaagatgcatggaaataagtggaaatgtgtcctgaaaatgtggaaatgtgtcctgaaaatgtagaaatgagagagggacacaaaaataggtaaaccacaattgcattatatatgagcttgaacatctccatgatatattaacattggaaatctaagtcatatgggtaatttcaaggtttttttaaattacaacaaagtacataaagataaataaattggcatggaaaaagagtcagacaaaagttccagtcttttcacaaagccagcattttagcagtttctcaattaccctgaacatttactactgctgatactgcacaatgagctgtctcttagaaaaatgtgaaaatgtgtacatattgtacatattgttatattgatcactaagcagggtagtaaaggaagacaattggtaagcagaagttcagattaatagtataaaatatgatgtaaatattaaaacacagggaaggaaatgtgctatcaaattcttgattcagcttgctatactggatattctccaagagtaagagatttagtttataggctaaatctaagaatggaaaaatggaaaattactccatttcctctgtggctgttgctgctgttgtcactttggtgaaatgtatagccacaggaaatttgacatttatatttcttgttacaattaatgcacaaaaaactatagaaaaccttaggacacttagaaactgattttatctttaatgtaattatcttaactataaatcttgacaaaatctacagccatctgaacaaattcttaattaaaagaaaaaaggagaatcagacattaatgtcaggaaatgagttctgcacccaagttgagattctttattttggaaaagatacacaatggtaggagaaaaggcaaatatccatatgaactaaatgcctcttgtgtaaaagatacagtgctaggctctagaaccacaattttaattccaaaagatccctacatacaatcttatttaaacctccacaattttcagcaaacggagcataataaagttaaatatatgtgaccaagattactcctagatagggcaagaactggaatacaaggatctttcacatccaagaccctgttctttctagttagctgtggggccaaggcacagcatgcaaaacctgtcatgtacatggcacggagctcttggctttcctagttcctaattcagtcatttaatagtctgtctgtatctacagaattactttcatgaccaagaattgatatttttgttattggtcaaatttgaacatactagtactgagggcaaagctttgcagcatgtccttagaacccttcctccaggtggagataattctctttatcaacacaagcggaggtttggcactgaaccaatattaaccgcaacttgaaagcagttcatttttctttacctgattcacaaggctaacagaagactagaaaacatctttcctgaatttagacaaactttgtctattccacttccacagtaggaatttttaataaataatctttgacgaatgaaggtggatctgatatagtataacattcacattgtttccattctctatatagacaccacttctttattcttattgatgcattttataattataatcatttaaatattatgttttatgtccaatcatacagctgttgattagtataatttattctctttccatcttgctaattagtcattggtcttgtagcatttatgttgtacaaggccagtgttgtagatagttactccaagatgtcagtagggagtcatttgtgcccctcacgcatatattttgggatgtattttgtcattgccaaggatttttaaattatttataggagaatgtgactacattttcttccaacctgagatggaatgaagtagtctttatttatggaaatactatgtagaagagatggatagcaaatcttttctgtttccaaagtgaatgagttcaaattgtagtcatatggatttagtgagctgtaaataagatgctaactctaagaagcattacaaatgactttgagaagatatctatagttttcttacttagggaacagtatgatataggcaagactaagaaaataaaatagcatatttaatttcttttaccaaatatcctaaatatgaaatctgttagcccctctactcatttcctccttacagtcttcgattttagtacagaataggagcaaggcaagggattcatgaaattttagattcttatcagatctatcattctagaatagttttttacaactgcaagtgtattttaagttagtttgtgagttgaacactagatatttaaaattcaacttttcatatgccaacctatggtgtattgaataaagacataaagtttcaaattttgttgtataattgttataattttaaacagatagtttcaataatgattttcatacattgcattttagccaatgttttaataggtagccaaaatctttgactatctactaataagtagactaaagttgacaaggatcagtttccttttctagatactaaattattctcaaattggaatgtaagcattaatataacttggtcagcaaacaggataatgttaagaaagcattctctcttaaaatttatagaagtatcataatttcaatttccaacttgaatatcatagtaatgtattgaatagtacacattttttgaaggagagctttggcaagattagtaaccaattatcattgaaaaaaatgaactaaacttagcctaggctttgaggattgtgtgacaattgttattctatattttgaaattagttgaatatactttcctttaaagtatagggatttttaagttaaatacttggctacatttaagaggttcaacactctaattttaatggtaaggaaacatttttaaagctatcagcttatttctcaagggtaatattcagtctttttacctagtgctagttaataccagtgttgttatttttaaactattgctacttaggcagaacataataaaaatcgagtgggagtagttaatccaaaattatctaaaagtttcatattaattcaaagtttaaatatgctaggttctatataacataaaaatgtgagatatttctactggctatacttcaaagaatataattcacaaggcttgaaattgaccacagttcctaaaagtagtgggagaaagagaaatggaagcaatgctcttcaatatttacaaaggtcttctgctcgtgactagcctaaaattttttcagctcttatatattcttgtacatgagtaattgggagttcaatcagcatctgctagcctttcattatttattatttatttctgtgggtacatagtagaggtatacatttatgagttccatgagatattttaatacaggataatgcggtatccatcacttcaagcatttatcttttgcattacaaacaatctaattatacttttttagtaattttaaatgtacaattaaattattgttgacggtagtcattctgttgtgctatataatatgggaacttattcattcttcgaactatatttttgtacccaataacacttcccacttcacccctactttcccactacccttccaacctctgggaccttccttctactctctatctccatgagctcaattattttcatttctagctcccacacgtaagtgggaccatacaaacttcatctttctgtgcctggcttatttcacttaacataatgacctctagttccatccatgttgttgcaagtgaaagaatctcattcttttatggctgaaaagtactccattgtgtatatgtaccacatttgctttatccattcatctgttgatggacatttaggttgcttccaagtcttggctattgtgaataatgttgcaataaacatgggaatggatatgtctctttgacatgctgatttccttccttttggttatgtacctaggagtgggattgctggattatatggtagtgctatttttatttttatttgagaaacttccaaactgttctccatagtgtttgtgttaatttacattcccatcaactgtatgagagtttcctttcctccacatccttgccaggatttgtgattgcctgacttttggataaagccattttagttggggtaaaatgataactcattgtagtttggaattgcacttctttgatgatcaataatgttgagcatcttttttatgcttgttggccatttgtatgtcttcttttgagaaatgtctattcagatcctttgcccatttttaattggattattagatttttttcctagagagttgtttgagttactgatatattctggttattaactccttgtcagatggggagattgcaaatattttctcccattctgtgggttatctcttcactttactgattgcttcctttgctgcacagaagctttttaacttgatgtgatctccttttgtccattttggttttggttgcctgtgcttgttgggtattactcaagaactctttgcctagttcaatggcctggatcattgacccaatgtttttgtgtagtagtttcatagtttcaggtcttagatttaagtttttaatccatttagatttgatttttgtatatattacatagcccctttgaggctgttttctagatgctgtaggtatgcttcattgtttttttatttgtttttcttttgtttcctcttactgtacattttcaaatagcctgccttcaagctcactaattctttcttctgtttgatcaattctgctgttaaaagactaatgcattcctcagtatataaattgtatttttcaactccagcaatttttcttgattctttttaattatttcaatgtctttgctaaattgatttgatagaattctgaattccttgtgttctcttgaatttctttgagtttcctcaaaattgcagtttggaattctccgtctgaaaggtcacatatctttgtttctccagaattggtccttggtgacttatttagttcattgcatgaggtcatgttttcctgggtgatcctgaaggtcatggatgtttgtctgtgtctgggcattgaagagtttgttatttattgtagtcttcacagtctacgcccatttggacccatccttcttgggaaggatttctagatattcaaaaggacttgggtattgtgatctaggccacatctgcattagggggtaccacatacctagtaaggctgtggttcttgcagactcacagagatactgccttgttggtcttggataagatccagaggaattctctggatttccagacagaggctcttgttctcttccttcactttcttccaaatatagtcccttttcctgttctgagccacctggagctgggtgaggtggatggggtgacacaagcagcctgtggccaccaccactggaactgcattgggtcacacataaagcaaacacagcactggggttcacccaaagcctgttttaatcaccatctggagatatacctaatgtaaatgatgagttagtgggtgcagcacaccaacatggcacatgtatacatacgtaacaaacctgcacattgtgcacatgtaccctagaacttaaagtataataatatatttatatatatttatatataaatatgtattatttatatatatttatatataaatatgtattatttatatataaatatataaaataaatttaataaaataaatatataaaataaatttaataaaataaaatttatataaaatatataaatatattatatataaatatataatatatatttaatatatataaatatatataaataaatatatattatatcatatataatatatatttatatatataaatatatataaataaatatatattatatcatatataatatatatattatatatgatgtatataatatatattatatatgatatatatattttatatataataatatattatataataatatatatatcttatatataataatatatatatctcatatataataatatatatatcttatatataataatatatatatctcatatataataatatatatatcttatatataataatatatatatctcatatataataatatatatatcttatatataataatatatatatctcatatataataatatatatatcttatatataataatatatatataaaataatgaccacctggctaccatctatgcttgcaggctggcatactacaatgagcaggtggcgaagccagccaggcttgtgtccttcccttcagggtggtaagttctcccaggtagatccagaggtgttctggtgggtccagagttcctcctaggtgggtccagaggtgctgtctgggagtcagggacaagagtcaaaaaccttagaagtctactttgtgttctattgtactgtggctgagctggcattcaaaccacaagaatcagttgtttcccctcttccgtcttcatttcaaaggcagaggacacttcctgtggccaccactgccacaggcctacagggagtactgccagactaccacctatgttcacttaaggcccagagtgttttaagtcagcttgtggtaaatgctgcctggcctgggattcacccttcagggcagtgggctcccatctggtccaggtaggtccaaaaatgttgtccaagtgtcaaggtctgtaatcagagaccctaagagcccactttgtgctctacctccttgtggctgagctggtacttaacatggaagataaagtcccctttacttttcccttagcttttctcaagcagaaggtgtttttccctatagcccccacagctgggaatgtgctgagtctcacttgaagctagcatgtctcaggctcacccaaggcccatggtgtactacctgggtattgccactggttattcaggctctcaaaggctttttagtcagtcggtgatgggtcttgctgtgactgggtccttcccttcaaggcagtgggttcccttctagtccaggttgtgtctagaaatgtcatcctgcacctagaacctggaaagggagcctcataactctgactggtgccctatcttattgtggctgagctagtatccaagatgcaaaacagtcttctttactctttcctctcctttcccaagtggaaggagccagttccttttgaacccatgagccctgctgcctgggattgtggggaggtggtacatgcacccccttagtcagccccactgatgtctcagtaggttgtacaccacccaagtccactggttgtgagccccgcacagcactatgactcacataggagttgcggtctttgtggcctatactgcatttaaagtttatttagagtcccagaggactttagcccactgtggtgaggcgtgggagaactcaacttctgacccgtgggatgggtgactcccatctggctagggctggattaaatattccctctatgcacaggcatcagctagatttggatcagttttgctttctcctgtgacagggcaatgtctaacaattgctgtcctttctctcccaagggcaaagattctctctccatgccacatggctgctgctggggatgggatggggtgtcactggcaattcaagactgtctttactacactcttcagtgtctctttcagctatatgaagttaaaatcagataccatgagagctctcgtgatttttggttcttaggaaatgattatttttgtgtgtagatagatgttacattggtgtccttctggggtgatgatcagtggaggcttctatttgaccatcctgctccaccccgtgtagtctcttattattaagagtctggctcagagtagtgtatagaattgtttttcccaatagtcatgattagtttgcactcatgtagccaatacttttttttaatgtctatgtccaatctgtaatatcaaagatatattctctaggagacaacatatgaataaatggtccatccagggtagaacttctgtgttttaagtaatgatatgaaaaaatccaaaataacatgattattagtaatagctgtattctaaacaactccagaacaatattttgactttagataaaaagaaaaaaattaagagaagggccagctatattttaaaattttattattttgaacaatatgcatattagtgcctagatatcaatgctcataccaataactgactgtaaaagaaatctaaggacaaacagatttattatgagaagtccatgatgtaaggggccatttcgtattatttcagcctagaatacaaaccaagaggaagacatataaactggaactttaaaatgtcttacttttttgaaatattctagaagggtcacactcccagtctgaattagtatttctattttgaaactgtggagtaatgaaatcaaaaggtaatgttttgccttactctcaccatttatttagagacaaaattaaaaaaaaaatccctcttcctttttgttccctctgggactctgaattcaaaaacaaaagaaacactcagattaaatttttatttctttctagaaaaacattacatgcatatgaagaaaaactataatctacaatcactgggtttattttaatttgtttaggcgtacacagtgaaatgtttaaaaaaaaagctgaaactggatcccttccttacaccttatacaaaaattaattcaagatggattaaagacttacatgttcgacttaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaattttcacaacctactcatctgacaaagggctaatatccagaatctacaatgaactcaaacaaatttacaagaaaaaacaaacaaccccttcaaaaagtgggcgaaggatatgaacagatacttctcaaaagaagacatttatgcagccaaaaaacacatgaaaaaatgctcatcatcactggccatcagagaaatgcaaatcaaaaccacaatgagataccatctcacaccagttagaatggcgagcattaaaaagtcaggaaacaacaggtgctggagaggatgtggggaaataggaacacttttacactgttggtgggactgtaaactagttcagccattgtggaagtcagtgtggcgattcctcagggatctagaactagaaataccatttgacccagccttcccattactgggtatatacccaaaggattataaatcatgctgctataaagacacatgcacacgtatgtttattgtggcactattcacaatagcaaagacttggaaccaacccaaatgtccaacaacgatagactggattaagaaactgtggcacatatacaccatggaatactatgcagccataaaaaatgatgagttcatgtcctttgtagtgacatggatgaaactggaaacatcattctcagcaaactattgcaaggacaaaaatccacacaccgcatgttctcactcattggtgggaactgaaccatgagaacagatggacacaggaaggggaacatcacacaccagggactgttgtggggtggggggaggggggagggatagcattaggagatatacctaatgctaaatgacgagttaatggctgcagcacaccaacgtggcacatgtatacatatgtaacaaacctgcacattgtgcacatgtaccctaaaacttaaagtataataataataaaattaaaaaaaaaagaaataaatgacagaaactaaccaggtactatagagaaattattctgaaatacatagaacctaacatcagtcattgactctgatgatacctaagatatagctataagaaattatcccaagaaaagagtatctttcaacatgagcaagatgttatataaggcgggttgaaattacaaaggggagagagatactgttcatgtaagagggccatgtttttgaagctctcctcgctttaggattcgtttgtaggtgccagaggccatttggttgtttgtgcacattatttttaagtaaagctttttgaaagaaaaataaaattgaattacatacacagtagatatatttttgtacatcctgaaatgagtaaattgatctgggaaagctcattcttactttttgttttcaaatgctagaaatcatggtaaatgttaaccaaacataaatgtggtctagtattatttgtcaatatcagagaaaaagcactattaaaatggaatccattttgtacattgcatttttaaaacctgattgatcactgttaagtgagtttttgtagctaagtgtttttaagactgttgactgaattttaaaggaaatgtccatgtgttgctagtagtactgtgtaaataagtcataaatggaacaaacaataatgattggcataatcagtaggattcattcatctttgataaaacctctccaagatgcattaggtacaccccaactgtggagaaaaggatggaatgtgtttccttttaactccacaaatttatgaaaaaaatctaacttatttagtcgcataacgatagtagaaaaaatctcaataaaataatcctagtaaaatataatattttagaggtgtttttgtttcatgtaaattagaaacagcctttttaatgtcactcaataaattatagaatagtattaatacaatcctcatcctttaatcatacatacatataaaatgtcttatcaggggaaagaacacacagagaaagtgagagagaaataaaaagagacgaggggatacaggaaagatagatgtatattagaaaattattgcactttctagaagagatgtcattcctgggataaaagaagccttgagcagattatagaatacatcagaggcattcttttcaataaatgacaaagaaagatagagttgcaaaaatacaatcaactggaatagtgaaattttagcaatttcagcagagtaattaagaatactttacaaaaggcaatttttaagaagtccttatgtaatgaattaactattatataacagactgattacagtatgtggacagcagcttatacaaaaccaaaagaaaagaaaaaaaattaaaacaaagacattaaaaacaggagtagagcatcagatcatattgtattaacatgccatgactagattgcttttctttctgatataccataacctatacaaatgctaggtaaacaacatggaccagtacctttcttttggcctttagctgctcatgatacttgtcacaggtatctcctgggatttctcctccccagagagtaattccaacaatggtgtatgtaatacccatgatgagcaatgggaaacagtacaccagtataatgacgataatatggtaactatgaaaaataagaaaaacacatgctgaagaccttattggaatgaaatattggggactgaattggctcagctttaaatcataattaaaactaccaagagttatttctacattatctctatacattcatctcaaaattccatcaaaatatcatgctattgtcacttatatttatgtttcaaatgctgccagttgatgttgtcaatctttacttggtatatgaaaactatagctgggttgaagggctcagttaaacataagttctccttgcctagaggttgaggaggaacgactttccactgctatgtactctgcttggtaattgttgagctaaaccaattaaatgtatcattggaggaaaagggaagggatagaataaatgaatcaaccggcatatgttttctcctatataggactgtcttctctattgctgcaacatcagacatacataaactgtttttcattcaaatggtgggaaaaaagtaagtagatactctgagccataattaatccacaagttactacaatttttaaaaatcaggtaaagacatttacatgcaattttccagtctgggtccatttgattgcattgttaacttggtaaaaacaaaacaaaacaaaacaaaacaaaaaaacatgtcgacatagtagtcaaacgagaagtatgctgctgtgaattatcaaattaaattctggtatttagtagctttcaatcaaaattataagaattcaattagcgaggaaaaggagagtaagccatactacaatagcccaaatataatttataattttacaaaatttgtatggatttcactgtcttggaaagctttaaagtaattaaaaagtttgttagaacggtcttctccataccagtgttttttttgttttgttttgttttttgtaaagtgaatcttaaatatccttgcctttccatttctcagtagattactaagtattgatttaaagtcaatgaggaaataattcagtcaacaaataatttgaagatgataacattatcatacaattaagatgtattaataatatgaatagggtactcagtttaatatgagctgtctgattttccttaaataagtgcctcctaatatttttgttcaaaaatctgaactttgggtagagcaaaggtagataaaatgactgctttaaatggcaaccattatttgcaccatttgttatttttaaagggaaaaattggtgagtaaaatagaaaaataagtacattattaaaataaaatttaagattataatttaaaaatcaaatgcaataaattacacaattacattattattccttcttgctctatttaatgtgggtataaaatatgaaccaaattttaccatatattatagcatttgtatttccttttcaatctagtgttcaggttttttaatgctttttgcttgtctagagacaagcaaaagaacacaaaccaaatcaaaccaaaataaaattagataacctactagggtgctccttcccttcagctacacttcctaaaagagcaatcaacacatttgggctttgatttcttccttctcactcatttctcaatcaataacacaatgcttttctttgcacattgcttttatcttttatcacttccttcaggaaactctccagtgccatcccacatagacatcctcatatttccaattaaaaaccttagtaacttacacaacttattgaccacacacaaatcataccatattacagtatttttatatatttccttttccaaataatgtatgaaccctgggggaaatgtcagtcttatttaattgttgctcctaatctgtagtttcctaaatgtttgataaactgaattgaaaaccataatagagaattaacttacgtgaaatgttgtttgggaccttctggccattgcacaaagcagagagtacggcctggcatgactttggttttggaataaagacactgagggaaggcaagtagaaatgctagaatccaaatacttccaatgacaatcttggttgctgtagcagacagtctgggtttcaagggatcaataatagccatatacctatataaaaacaaacaaaaccatttcattggttttctttataacagagtttgaaatggagtttcaaaggtatttcaaaggcgtttcaatagttacagtcattgctcttttgggaaaccagttgataaggactgcttgagtagaggcagcgtagaatggtaatcatggcatagtctaggaatcaggaagatctaggttcaaattctattctgacacttgtttaaactttttgaacctcagctttattatttttaaaattgaaataagaacacccatctcttggggtaaagtgaggatcaacagatgtaagtcagcggtgcccagccttttggcaccaaggatcggttttatggaagataatttttttccatggactggcagtgggtgagggagcgatggtgtggggatgattcaagggcattacatttattgcacactttatttctgttgtgattccattgtaatatataataaaataattatacaacttgccataatgtagaatccgtgggagccctgagcttgttttcctgcaactagacggtcccatctggggttgatgggagacagcgacagatcatcacacattaagttctcataaggagcactcaacttagattcttcgcacctacagttcacaataaggttggctttctatgagaatctaatgccgctgacctgacaggaggcggagctcaggcagtaatgcagcactggggaatggcagtaaaaacagatgaagcttcttagctcaccagccaccactcacttcctgctgtgcagcctggttctaacaggccaggaactggtactggtccctaacccagggaactgggtacctccgatgtaagtgaaagatattaatgatttggtattgtgcctaacacattagaattcataaatgtctgttgaatggaattggaaaagcacttaataagtgcttacaaatactggtttcacagctcaaaaccttcatgtctcctctgtatgtttaacttttaaacatataatttctagagaaataatatggattataccacatacttgacaaagatgtgaaactcctataaaagatatggtccataaacccatttaagagcagcaggagataagttcagaatttccgtgattaataaatcaagttcgattgaggctatgccttcctgttatacctcatattgaattcatactgcctcatgaacatcttcatggtgcctatctgtgtaactacatataacactgttgtaacggaaaaatatatttgagtctctaaaaagtatacttaaagcatacttaaatatgacttttggagggcaacttcttggggaagttaggaattctgtaaatatggtaagtagagtcatgctttattaacttagtaccagagtaacaatatagctgaaagaagcaacttccaattttgaactggagatagcatggctaattgccaaattctagctaatgttcagagacaaaaataatatgtaccaaacaaattagctttttgtattttaataaaacacgatctttatgttgtttcaattctacttttggtcattttatgtttatagaatatattttgatttatgaaaaattttcagacgtaatactttcatcaaagaatgaatatcgcataggccaaaaaatgttaaccttaagaataaatatttcaaaataaggatattttatcaatatgtttataaatctttgttgttgtaactactgggcagaattaaattttcagaagatattgtgaaaattatctatataatattcttaatattaactatagtcatgatttacctaaagaaaacagtcttaattcattatgtataacagccattaggtaaacatgaaacttagatttgaaaaataatcatatttgtccttttgtgactggcttaattcactacatgattccaaatatatgtagtatctaaaagagtgaaacttatgaaagcatagaacagataatgattgctcagggctcaatgtatataaagttttaataatgcaagataaagaagttctagacttctgctgtataacatagtacctatagttagcaataaattatcatgaactttatcatgttaaaaggatagatcccatgttaagtgttcttaacacacacacacacacacaacaaatacacacacataagaacacaaggaaattttttgaggtgatggatatgtttagtgccttgattgtggcgatatcatgtttttccaagctcatcaaaatgtatacattaaatatgtgcattttttgtatatcaagtatacctcaataaagcttacagaaagagaaaagaaaaagtagtgacaaaaaaatacctaagtttaggaaaacagtgtgaactctacaaagaaaaataatgcgtatgtttcaaataggagactttaaaattcaactctcatggttattttggtgaagataataataaaaaaattgattgttaaccataactagggtacataatgtatgtaatagggttacatacatcatatatacttaatagccataataatccaaccacagaataatactattacctctattttacagaaaggaaaactgaggcttaaaagattatgggaattgttcataatgatccagataataagagaagagctagaattttaagccagttttgccagtcttcaaagacaatatagatacagattatagattttgaatataaccatttattttaggagagaaatatatatatttctcctccatgatatatatgttagatacttatgtgttatatgtgtgtgtgtgttagagatacccaccaaagaatcagaagtagaattttgccattttgcatttttgaatctaaaagcctttatgtgtaacattaaaacaaaggtaaaatatataaaggaattatatgtgggcatttctgttcctgctcatgttgattataactcacatagcatttatttcaatataggaattatttctgtattggtgtttcaaagccaagcacctgtcaataaatttgttgtactgaactgaatatccctcaaatctcattataatcttttgctttgttgcttgctctggcatctaatgaatgtgatttaggtatttagacagttgattttctgagagtaaagggagaagtggaataacacaagcaagcttaaagccctgtacaactcctgtagcacagataattcaaagtaaattgcaaatcgcattgattcttctggccagtctaattagtctaatgctagagaaggtattttctgaaataatttctacctgttagaaattaatttctaacaggtaaaatatcattttacttgaattacatggaaataatcagtttatgttctcatgaacatgttagtgatagtagagatactgaaacttctagcatacctttttgtcatagctggtctgatccatgattcatttattcaataaaacatttattgaatgcctactatggtattccaaacactagtgatccaacactgggcaaaaatggttttctgtgaagtagaaaaatacttcccaaattgtgaagtccataccatttgtgaagcagacaaatactaatcaaataatctcaccaataaatgtaaattacagatgtgacagctgttacgaaggtaaggccaagtgtatacatgaactgagaaaaatgtatttagattgtacttcaattgtccctaagaaaagtcattctaggttgaaacttggaaggataaccaggcaaggtggcagaagagtgagggttgcaaagatttctgggagaatgaacagcatgtgaaaaactcctatgttgatggtgttttttttttttttttttttgagactgagtcttgctctgtcgcccaggccgtaagtgcagtggcacgatcttggctcactgcaacctccacctcccaggttcaagcaattctcttgtctcagcctcctgagtagctgggactacagatgcccgccaccacgcccggctaatttttgtatttttagtagagagggggtttcccatattggttaggctggtctcgaattcctgacctcaggtgatctgcctgcctcagcctcccaaagttctgggattacaggcatgagccaccgccccagcctgatggtgggtttttacggtttgaattgtgaccctccaaaaaagatatattgaggacccaacacccagtatcacagaccttatttggaaatagattctttacataggtaattgggcttaaatcaggtcattagggtggtctctaacccaatatgactagtgtccttgtttaaagggaaaatttggaaacagatatgtagggagaatgttatgtgaagacagaagattgaaatgtggcatcaacaagccaagaaacagcaaagattgccagcaaatcaccagaagctaggttaagacaaggaaagagtcccctacaggttcttgagggagcatgtatcatggagcatcgatttcaaacttccagccaccagaacaataagactataaattactgttatttaaaggcactcaaatatgtggtacattgttacagcagccctaacaaactaagacagtgggtacaggtggaagaagcatcatattctttagtaattacaggatactgcaattgatacacagaaagtaaagagggaaggtggtttaagatgaagttatagtacaggttgtggattttttttgccagtggaaagtaattgaggcaattttatcagagaagtagaataatcagatttcctccagaaaagagcttcgagcttcagtctggagactggaagaggaaaagaatggaagcaaatgttgggcacagtggctcacacctgtaaccccagcactttgggagcccaaggtgggcggatcacttgaggccaggagtttgagaccagcctggccaacatggagaaacctcatctctactagaaatacaaaaattaacctggtgtggtggcacaggcctgtaatcccagctactcaagaggttgaggtatgagcatctcttgagcctggcaggtggaggttgcagtgagcagagatcacatcactgccctccagcctgagtgacagagcaagactctgtctcataaaaaataaaaaacatatatataaagaatggaagcagggaagtaagttatctaacttatgttctgatttggttcagagataattgctgcttagattagggcattaccactggaggttgaattaagtgaatgatttgaggaaagtaaagaaataccaaaatactgttgtagaaagggacacttggttggccaaagaaatagggagaattgccaggctctgatgaaaacttatttgaaattgttgatttggaattcgtttgggcaccaatattttctattttgtaactttcttcagcaacaataatttgcgtggagaggatggatatttaggttcacctgaacaaacattctctggaccttgagaataaatagtcagatgtgagatataatttcacccaaataattgtcagtgctttattgctttaaaaaatattttatgtgattacatcagcttttccaaggatttttgctgagcttctcatcaccattcttccttcaccagattcttaaagacattagaatctccttagtaggattatttcataagtaacagctaagagctgattctttactcttcatattagcataccacctaaacatgttttaaagtcactttttattatcctttatagaagctgaaattctcagaagcatctattgaaaactaatagttttaaagccacctcttaaaagttttcctttccactctaatactagaccgctttgctttaccacttactatttttctgatataattgaggtggtcttttatgtttacttattgtcttttgaaaggcagattagtttggatgtaacttttgtctgatgtcaataagaaagcctttccaattttgtaattgttatttgtatctattataattcttccttttgttggcatttttattaagttgtttctggatttttatgagcttttacatatcttcaagtttttcaatgaagacagaatccagccttcagatgtttatttgattgtagaaactatgcaaaaaataatttgcctaaaatgatacgaattttactctcttccaatcaatttgctcctggtcatagtagcatatgttctagtctgttaagtcccaaacacaaaatacggtctggctactctctgtgcaaaataaagattagttgcaacagctgctcatgacccatgaagtttcaacttctggccttcagtgctagggtattttctgcttctctgctttgacaaatcatttgagagatacatgacctttgtcaaaatgcattttctagatacattttattttgtgatttttttcataactgccttttctattctttgtttgtttgtttggttgatgggcctcttgctctgttgccaaggctggagtgcagaggtgtgatcacagctcactgaacctccaactcttggctcaagtgatctttctgcctcagctctctgagtagctgagactacaggtgcatgcctggctagtttttttttttttcctgtatttcttgtagagatgaggattcaccatgttgtccaggctggtcttgaattcttgggttcaagctttctgtccaccttggcctcccaaagtgctgggattacaggcatgaaccaccaaacccggcccataactgtcttagacaaacttaagaataaatgaatcatttagatgattataaatgttgtcttaataaatttcaaagtgaataagcttttattaaaataatctatatttgctgactcatgtatgactcatatatgactatgactattcatatatgtatatatgactatgactattcatatatgtatatatgaatatatacatataataggatattatctgtcaagaaacaaatcacttgttcatctaaaattctttgatttttataagtaaaatgtatatactgatatttgagggaaattatatttaaaacagcttcagaatagtgaaagtatttgtttctatgttataggcattcaatttagatttagaattaggtttatctactcatttatgtatttattttaaagaacttcttgaataccagctatcttctgggattttgttatcttttttggcaatattgatgaacaaaatagaagtagctcctgcccttgtggagttcagagtctaatgcagaagaaatatattactcaagtagtcacaaaataggttagaaattatcacacaaatttcccttgaagtaacgttgcctccaggatatttggttaaatgttccttggggctttagtgtgatggcctgtgtgctcagtaccataccccatgatttttaaagttaccaatctgacttttaaagttccctctgtcactattcttaaatcagtaaaaaatatacgtatgatttccaaaagaaatttaattatataaagcatttcagatttcaaaattatattgaacttagagatttatgagagaggagaatacactgccattctttgtcctgatgtttgtccttgagtttgttctttttgtaatgttcacctaattttctaaaaccctacatacatcatgggtgactcttcatttacaacctcttgtgaagtttaacccagtccctcactccctcattaaactggtaggtctagctcaaccttttggaaattctggtgaataaaaatttcctcattgtttacagtgtgatattataaagctatgtacaagtaattatgaagcataaaatagggaattagacctcgtcttggttataagtggacacagtggtaaagacattaggtataacttccacaagaaagcaacattaagattagaaaaataagtgggggcttatttagggtgaaggtgggaatgagagaaggaagttgaacagcaaagtcctgaggtaggagaaagcagagtgcatttggggaactatggaaggccagctctacagcatacaggacagggaaaaaacaggtggtactgaatgaagctagagatttaggtattaaacatgacctcattaatatattgattataaatataaattttctattttaacaataaaagtaataattgctaatgcatgaatgcttaggtaccatacactctaagaactttatatataactcatttaatactaaaattttaattttttacttaaatagtaattacaaaatgatttgtatcaaaatgctgcatcagtaaagaatattacatgaaacaatgcctactcaaaatttcagataacagatttagaagtagtaatctatagtggcaatataaaacttgctaaattttttgctacttatactatctctgtaataagtagttttaaaatcagaacatatttgattatttcacccataagacataaaattctaaatcactcttttgaagtccagtttactgacattttgtgtcacctctatattgtctcaaaaaccacttccataagtaacttcaaaagagctgcttcataaagtcacttcagtgtcatcaattacatattaaaaactttgagttcaggccaggcatggtgactcatgcctgtaatcccagcacttcaggaggccaaggtgggtggatcacctgaggtcagaagttcaagaccagcctggccaacatgttgaaaccccttctctactaaaaatacaaaaattaagcaggcttgatggtgcatgcctgtaatcccagctacttgggaggctgaggcaggagaatcacttgaacccaggaggcggaggttgcagtgagtcaagatcgcgccattgcattccagcttgggcacagagtgagactttgtctcaaaaacaaaacaaaacaaaacaaaaacaaaaaaactttgagctcaaatatttttagctcccacatacaggtactgaagaggatagggtaaagaaagtacagttaataaatacaaaaatacaattagatagaagaaataagatctagtgtttagtatcacaacagggcagcttatttagctaatactaatttattgtatatttctaaataactaaataactaagagactagaattagaatgtttctaacacaaaagtgctaacagcttgaggtgatggatactccaataactctgatttgatcattacacattatatgcttttatcaaaatattacttgtgccccataaatatgtacacctattatgtatttataataatgtaaaaatactagtacactaaaagaccacactttaccacttatcttacatgaatgtaagaaatctgcacttataaccccctcaaagttgtaaaacatttaaaagaaataacaaagattaaaacaaattttattaaaacaactttattgagagtttaattccctatgaaaacacttttgaactcttagcagattgttattattattatttccttctgagatggggtctctgtcacccagactggagtgcagtggtgtgatcttggctcactgcaatctctgcctcctgggctcaagtgatcctcccacctcagtctcctgagtagctgggaccagaggtgtgccccaacactcccagctattttttatatttttagtagagatagtgggatctcaccatgttgtccaggctggtcttgaaatcctgagttcaagtgatgagcccacctcagtctcccaaattggtgaatcaccacacctggccagaagattatttttttgaaaacaattcctttactgacatacaggagaaccttggatatgttgtaggtctggttccagaccaccacaataaagtaaatattgcagtaaagcaagtcacagaaattataggtttcccagcacatttaaagcttatgtttccactgtactgtagtctatcaagtgtgcaatagcattatgtctaaaaaatgtacatagcttaattaaaaattacttactgataaaatgctaatgatcatctgatccttcagcaagtcataatcatttgctggtggagattcttgcctcaatattggtagctgctgactgatcagggtggtggttgctgaaagttgaggtggctgttgcaatttttgttggtatgtaagaatgcttactttttaaattttatttcaatctttaattttttttgagtacataacagttgtttcggccaggtgtggtggcccacacctgtaatcccagcattttgggaggccgaggcaggcagatcacctgaggtcaggagttcaagaccagcctggccaacatggtgaaaccccgtctctactaaaaatacaaaaaattagccagtcatggtgacatgcacctgtaatcccagctactcaggaggctgaggcaggagaattgcttgaactcgggaagtggagggtacagagagctgagattgtaccactgcactctgacctaggtgacagagtgagactctgtctcaaaaaaaaaaaaaaagtcgtatgtatttatgaagtatatgtgatattttgataaaatcgtatgatgtgtaatgatctgatcaaaataattaagatatccatcagctcaaggatttatcatttctttgtgtttggaacattccaaatccactcctctagttattttggaatacacaatatattttttttagttccaagtatgagtgaaaatatacaatatctgtctttctgtgcttggcttatttcacttaacataatatccttcagttttattcatatcgttgcaaatgacaggatttcattttttcatggctgaatagtattctattatgtatctattattaaaaataatggcaaaaacagcaattacttttgcaccaatctaatataccacattttctctttccattcattgatgaaaagttaagttgattccatatcatggctattgtgaatagtgctacaataaacatgggattgcagatattccttcaatatactagtttccttttttaaaatatatatctagcactgggcttgctggaatttctattttagttttttgaggaacctccatactgttttctagcagctgtactaatttacattccagcagttcatgagtgtttcctttgttctgcatcctcatcagcatctattactttttgtatttttcataaaagctattttaactgaggtaacatgatatctcattgtggctttaatttacatttctttgatgattagtgattctgagcatttttttaatatacttgttgatgatttgtatgtttgtcattgagaaatgtctgttcaggtcttttgcacatttaaaaatggtattatttgtttttctattgaggtatttgagtttcttatatattctggttcctaatttcttctcagttgaatattctacaaatatttcctcctatttttacctttgctgtgcagaagatttttttcattggtgtgatcccatttatggatttttttttctttgattgcctgtgcttttgtggtcttattccagaaatctttgataagacaaaagtccttaagtttttccacaatgttttctaatggtagtttcataatttaggtcttacatataagtctttaattaatttttatttgattttttatatggtgagagatagaggtctagtttcattcttctccataatggatatccagtttccctagaaccatttgttatatggtcatttcttgtcaaacttgtcatttccccaatgtatgttcctggcacctttgttgaaaatgaactggttgcaaacatgtggatttatttcatggttctctattctgttccattcgtctatgtgtctgttcttatgacagcacaatactgttttggtaactataaatttgcagtataacttgaagtcaggtaatgtaattcctcaagttttgttctttttgctcagaattactttggctatttgggatcttctgtgattccatacaacttttaggacttaaacaaattttctatgaagaatatcattggtattttgatgggaattgcattgaatctgtagagtgcttggggtagaatagacattttaacaatattaattcttccaggccatgaacatgaaatatcttcccatttttggtgtcctcttcagtttctttcatcaatatagagatctcttgcttctttggttaagtttattcctgggtattttattttatttgttgctattataaatgggattgctctcttgatttccttttcagatgtttactgttggcatataggaatgctattgatttttgtatgttgattttgtattgtccaactttattgaactcatttatcagttttaacagtttttcatttttagtggagtctttaggttttctaaatataagatcatatcgtttacaaacaagaataatttgacttctttctaatttggatatgctttatttctttctcttgtctaactactctggctatgaattccagtactatgttgaataaaaatggtgaaaatgggcatccttgtcttgttccagatcttacagaaaaggctgtcagtttttcccattcagtatgatactgtaggtttgttacatatcgcctttattggattgaggtatatttcttttatatccagtttgataacagtttttaatcatgacatgacattgaattttaccaaatgcttttttagcatcttctgaaatagtcatctattttttgtctttcattctgttgatgtaatgtttcatgtttatggatttgatgtgaatctcacctgatcatgatgagtgatctttttaatgtgttgttgaatttggcatgctagtatttgttgaggattattttcatctatattaatcaatattggtctgcagtttttaattttttttcttgtggtagtgtctctgcctggttttggtatcagggtaatgctggccctagagaatgagtttgaaagtattccctcttcctaatattttcagaatagtatgagtaggattggtgttagcttttctttaaatgtttggtagaattaagcattgaaaccatcaagtcctgggctcttctttgatgggagagtttttattactggctctatacattacataatattgggctatttaggttttctatttctttatggttcaatattaggaggttgtatgtattcaagaatttatccttttcttctaggttttcaaatttattggcttatagttgcacaatagtagtctctaatgatcctttaaatttttgagctatcaattgtaatatctaatttttcaactctgattttatttatttatattttctctcctttcttctttggctaaagatttgtcaagtttggttgtcttttcaaaaaagcaactttttattgtattgatcttttgatgtagatctttattgttataaacttccctcttagtcctgcttttgctgtatcccacaaaggtttttaaaaataagacaataatgaagtttaccacatcaattaactcttcttttcacaaaagatttcactgtagcatgcaatgctatttgatagcattttacccacagtagaatgtctttcaaagttgaagtcaatactctcaaaccctgctgctgctttatcagctaagtttatataatattctatattgtttattattatttcaacaatgttcacagtatcttgcccagaagtagattcaatttaaataaaccactttctttgttcatgcataagaagcagctcctcaacattaaagtttgattatgagattgcagcaattcagtcacatcttcaggctccacattcttgttcttttgctatttccactacaactgcagttacttccttcactgaagttttgaacccctcaaagtcatctatgatgttcttaatgctatctaaaatggtgaatcttttccagaagattctcaatttacttttcccagatccatcagaggaatcactatggcagctattgccttacaaaataaatttctgaaataataagacttgaaagtctaacttactctttgatccctgggctgcagaatgaatgttgtgtcttgtgtcagcagacatgaaaacaacattaatctcatatatctctatcagagctcttgggttactaggtgcattgccaatgagcagtgatattttgaaaggaatcttattttctgaacagtgagtcttaacaatggatttaaaatattcattaaaccatgccatgaacaaatgtgtcatcatccatgctgtgttgttcattttatagggcactggcagaatagacagcataatttttaagggccctaggatttttggaataacaaatgagcactggcttaacttcaagtcaccagctgcactaacccttagtaacagagtctgcctgtcatttgaagatttgaagtcaggcattgacttctcctctctagctatgaaagtcctagatggaatctttttacaatgtaagactgttttgtctacattgaaaatctgttctttaatatagccacctcatcaatgatcttaactaggtcctttagataacttgctgcagcttttcaacacttgctgctttgccttgcacttttatgttatggagatggcttctttccttatacctcaggaaccaaactctgctggccacaagttttcttctgcagcttcttcaactctttgagcttttatagcattgaaaagagctagatccttgacacgtattaggctttggcttaaggaaatgttgtggcttgtttgatcttgtatccagaccacttaaactctatatcagcaataaggctgctttgtttgcttaccatttggtgttcactggagtagcacttttaatttccattaataactcttactttccattcagaacttggctgtttggtgcaagaggcctagctttcagcctgtgttgggttttgatatgtcttcctcactaagcttaatcatttctagcttaactcactcaaatagcgagtgacattgtgactctttcatttcaacacttagaggacattgtatggttattaattggcttaatttcaacattgttatatgttaggaaatagggagtctcaaggagaggaagagagtcaggagcacatggagcagtcagaacatatacatttgctgatgaacttcactttcttacatgggcatggttcgtgaagctccaaaacaattaccagagtaacatcaatgatctctgatcataggtcaccagaacagatataataataataaaaagttaaaaatatggtgactattgccaaaatgtgacacgaaaaaatgaagtgacacatgctaccagcaaaatggcaccaatagttttgctcgatgcaggattgtcacaaacctttaatttgtaaaaagcacaatatctgcaaggtgtaataaagcatagtgagataaaatgatgtatgcctgtatgtgttaggttgaaattcacctataaataatatttctagtagtcaatgctttatagagataacacagaacactatacataattagctatacatgatactctatttagactgtaagctagatatacttttccaaatgtgtacaactccattcaatttcattttatttcattttttataagagaatgaggttttagatgaaaagggagtggcaaacggtggcttaaacgtggaggagttagaaagaataaaagtgaaagaaactcccaggtaggagcaatagacttattgcagagtagttaataggtaaaggaagtgaaacattttagccttgaaaagaggcagaacacttggaagctttagttaaatatatgaaaggctgtagtgaggaacagatttcaaaaacagtgttagaacactttatgagtaaaaactcagattacacagtttctatgagaaaaatgactcacagctagctatccagagcacaatgaattgtctccagtgctattatgtttttctgttttttttttttctctgttgttggaggtcctcaggaagagtgagtaaccatttattacatgaattaaataactataagctaccagataaactgtggaaatagatggaagtaggctccctcacaactctgagattctagttttcatcagaaggagcttgtcttaaagctgattaatcatagttccaggaccttatgttcataattcaactgatgaggacaagtaaacaaagctacatttttctcttgttttgttttgagatggagtctcgctctgtcaccaggctggagtgcagtggcacaatctcagctcactgcaacctctgcctcccgagttcatgccattctcctgcctcagcctcccaagtagctgagactgcaggcgcacacctccacgcctggctaatttttgtacttttagtagagatggggtttcaccatgttggccagaatggtcttgatctcttgacctcatgatctgcctgcctcggccttccaaagtgctgggattacaggcgtgagccaccgcgcccggcctacatgttttaattggtactgcaaggcattagtttttggcaggcatttttcttaaccaattatggacattaaaattctgtgaaaatagatgtaaattattttatatttatcctcctaaagaatgaatggcttcagaagaaatcttactatacttatataaaaatataggtgtttttcattcatgaaaaatgaacacttttttgagtatcctcattctaaatattattcatatggacataagagttattctaaaatcctccctttttctcacttcctttgcactgttgaagtcttatgcatccaatttctgacatcaccaaatctgttctttccctcttttctatcaatgcttggatcttgaaatgtcctcataatgagtttccctgctgtggctctttccttgctttcttcacaatatctccaaagttgtctttaaaaatattttcctacgtcttcactttctagaagattaactgcaattttgctcatgttttacaacagtgacactagacatcttatctttccccacaaacctactatattgtgggaaatatattaggaaataaggagtctcagtcagagctccaaggaaaatagatgacatgcaagaatgtgcaaactgaagagagtttaatgaagaggacatttacaaagttatcggtagacttcaaggaaattgatgtagaatgaatgttatccaggactagcaatgccagggagtgggtaccccacttcttcaggtgtgaagggtgaaaggatcctagaatctgaaatgaagatatgaagctctaggagatgaacatccaataagagatatgcttacaggttggaggcttagccaatttgcagcactcctgaaaggaaggagtggtagacacgtccgaaagccactctcatcatttcctcccatttcctccatgtgtctcccattaggcaacaccaagaaaaggccaaagagcaagggaccctattggtgcaatccacacaggtatttagcctgagtggaggggagggggcagagaaaagaaagaaatgataaggagtagatctgaaccgaaaaatcgaaattatccctcttgctcataccttttatttatataattggcaaatttctacccatgctttaatttccactcagatacagaataatcactctgaattatttcctttctattcttccatagctagttttttgcacactcagtgcttcaaagatattgtgcttagactttgatttcacctcattgttctaaatgagctacgagaggaaaaagatactgatttattcttctctgtgttctgtagcactcaccttgcagcttctggctcacaggagtcaatataattgttaagcagtgaatgcaaataattgtttaacatttgtacagatagatgaataattgttcacaaatgaggacttcagcatgtatatagattttaaaataagtagttttcttaactttgctaaatagaaataacaaacataacactatcataacgttaaaattacactacataacacaatatattcaaagagctagataatgtcagatgcagtagacagtcaacctaagttatcctaacctatattaaatataatagtgaaattaacacaggaagaaaaacagctatagagacaagatgcagacaaagacaaacaaatatagtgtgttaaaagtggttcttcagaataaagaatccagaaataagactacacatctaagactatctgatcttagacaaacctgataaaaacaagcagtggggaaaggattctctatttcataaatggtgctgggataactggttagccatatgcagaaaattgaaactggaccccttccttacaccatatacaaaaattaatcaagatggattaaagacttaaatgcaaaaccccataaaaaccctggaagacaatctaggcaataccattcaagacataggcacgggcaaagattttatgacaaagtttccaaaagcaattgcagcgaaagcaaaaatagacaaaagggatcatattaaactaaagagattcttcacagcaaaagaaactatcaagagtaaacagccaacctacagaatgggagaatatttttgcaatctatgcatctgacaaatgtctagtatccagcatctataaagaacttaacaaatttacaagaaaaaaataagcaaccccattaaaaagtggacaaaggacgagaacagacatttctcaaaagaagacatacatgtggccaacaaacatatgagaaaaactcaacatcactgatcattagagaaatgcatatcaaaaccacaatgagataccgtctcacaccagtcagaatgtctattattaaaaagtcaaaaagcaacagatgctggtgaggttgtggagaaaaaggaacacttttacactgttggtaggagtataaattatttcaatcattgtggaagacggtgtggtgattcctcaaagatgtagaagtggaaatactattcgacccagcaatcccattactgatatatacccaaaggaatataaatcattctattataaggacacatgcatgtgtatgtttattgcagcactattcacaaaaacaaagacatataatcaacctaatgcccatcagcaatagactagataaagaaaatgtggtacatataccacggaatactatgcagccctaaaaaggaatgagattatgtcctttgcagggacataaattgagttggaggctattatccttagcaaactaatgcaggaacagaaaaccaaatactgcatgctcttatttagaagtgggagctaaatgatgagaacacttggacacataagggagaacaacacacactggggccttttggagtgtggagggtgggaggaagaagagcatcatgaaggataactaatggatgctgggcttaatacctaggtgatgaaacgatctgtttggcaaaccaccatggtacaagtttacctatgtaacaaacctgtacatcctgcacatgtacccttgatcataaaataaaagctggaaataagaaaaaagaaaaaaggtggttcttaggtagttgtgagtggcatagaaagaaaaaaaaaagcatatgccaaattctgatatgaggattaaataaaactttggatattgtccctagcttttcaacagaaacctgtttcatcaaggtaatgtagcataggttatctttcttctaaatctctccgtttaaaacagttttgttgaatggagagtaatgagatcttctgtgcaacttgaataatggcaactagtgctcagtgattcaaggattaaatggaaatattcagtgtgactcttggagactttgtaaattcattggatgtactaggaattcattcctttcagttatgtctgatgttgatctacactgtatcaattttttttatcagttaaatagtagcttgtggcagtgccagtgtattctctttaaatttgcaaagatgatggtggccaacaagcatgaggatttccaaatcttaagggtatgtaagttgtgaagatggaaatatctatttagttgtgcaagtggaataaagcaagtattagataacttcaaaattcagataacaaagatgagaatcagaaacttttccatagttggcttttctttttaattgtattttcatcttattaaaattgatttaagcacaaactattaagttactttttaaaactttaaaaatcacctccattcatttattcattcatttatccatacaacaaatatgcattgagtgccaaataaatgaaagcattattctagaatgtgtgactataaaggtacacaaaatagatagcagtgggtactacgcagaaagataaaacagattaagtggatagaaaatgatgtgagtctgctgttttagagtggtcagttcatgcatgagatacacttagaaaataaaaggtagttgctttttttttttttaacagctgcttctctgtcctcacaccacatctataagattattttattttaataatcttttctctttgagggccataagtcttctcagtctttctgagctcatgggaggcaaatgacttattagtaatataatctgacttcaaaaagcaagtattttccagttctgtcattttcatgtctcaccactgaagaaaatcagggatgccagaaagttcacaccaaattattaattttctgtatggtggatttcagttccattaatttaagaacattattatgattactctataaatttcataaagtgctaactgacatcctctatgttgcattactgtgtaaatacaggaaattaaagtttttagttctggaggccctaactatgcccatttgcattgctttcttataggtaaaagccaatcataatcctgaatttatattcttctcttcgaaaacagtaaaatggaagtcatactttctgagtagaactgtgtgtatttctttgagatgacagtgtggcgtataaataatggctgttatggttaccttaatagcagcatatttcaaacctcaggactggaattgttaggtggtgaaagtattctgaggggatcatcatatctgattcctataaaccataactccaaataaatatttgaagtagtagtagtacttttggttttcctgaaacgggtgcaaagagctcccacatcagatgtcctttcattctcaggttttatatgcattgaaaagacatctcaataacaaccctttgtggagtaattgctgactttgaggaagctgggggagaggagatggtatgaatccttttaattgagctctacttgttttatgagacaccccctttaaaataactccctttaaagttttagtttgaggatacaaatttaaatttatgtaataacattccataatataatggtgactgtagataactgcagggaaaggtaagtagaatgatggtttgtaatgaaagctctccattggcagataaataaaagattggatatcaattatctctaacaaaaggtacactggaactacatagaatgcagaagctggggcagactaacaatacaagctctattatatatatatttttaaatatggagtagtttggtgtgataaacccttaaatcccattcaatgagaagctgtattattatattgctaagtaattatgtttctttatagtactcttaaatcctctaattgaaagcacttgttatgcctcaaattatactgtcagactgtgctcaagctatgtgcagtacttgagaacagataaaagtagagtgcttttgagggtttcatcacccatttgatgaaacatatgggatgtttcatcatatgggtgacgtttacataaacaataaaaaaagcccatatgagcttgggtactttttattgttagcaagtagaactaaccaattgaagcagcagtcacacctacagaacagaaagaaaatggtgcttagtctgtagaaatttttattctattgagataaggaggaatgtttaagcttgtttggagaaaaaaaatctgagcagacctagtaaaaatcaaacaacatgtattataatagaaaccagtatggaaatttgctctggtaacaatccattagaaagtttccagattaagtgatatatatatatatatatacatacatacacacacacacacacacatatatatatacacatatatatacatatatatacacatatatatatcacttaatatatatatttctcattattgtcaagtgaaaatgcaataagaactatatacagaatattttctcatttgtaccctaacagatagctaagaatagaaatctgtacagaaggctactttttcaggtctcatcatcatttacctaagtcatctatcacctgaaattactgttgacaactatagattttctggttttgttttctcaccatgaggatcttttaaactctctataataagccatttcatctatgttctcacttaatagggtaatagggctattaggaaattgaacattattttgatagctatgtttctacatctacctctttgataacagcattcacattttttcaaaagaaaactctaattataggagtagttttatttctgttaagttattttttctctaagctttctctttcttccttatattttttttctattttaataggtttgctttctcttgctaagataaactattttattgaaaatagagcataatattcttccttttaaaatattacactcaacagatttgcttgttttctttaaactggtaaaataggatatttaaaaaaatatttaccaaattcaagataaaatgtcactttagttattcagaggcagtcaaatcacatacagtattccacacaccccaacaaatacaaagtcacattcctacgtgttatgaaggatctctcaattccactcactttttgatgctaaaaactgtatctcaaaatatagtgtctctctctcacggcctaaatataacatcagaaatttattagatatatccttcttgttttgtcataacatctctcatttataattcatttgaaatcatagatcataaaatttgtagcttaatggaccttatataacggcataggtatattaaaagtaaaatggtagaaaaagatctaccatgtacatcaaggcaaagaaaattaccagagattctttatcttgtttaatgcttaaaggatcaatttaccaagaagacgaaataatcctaaatgcacataataacggtgcttcaaaatacgtgaatcaaaaattgactgaaataaatggtcagatccacaaattcacaattataattttgcatttcataatctttttagaacttataaaattagtagatagaaaatcagtgagaacatagaaaaactaaataactccaccaatgaactgcatctaactgacatttatggagcactgagtcaaacaagagcagaatatatacttttcaagtacaaataggcatttaccaagatgacccatattctagaatagaaaacaaaattttaaaagtgcaaaaaattaaaacaaatatatattcttagataataatggaattaaactggaaatcaataacaggaaagagaaaaatttccaaacttggaaattacacaaaacactcttaaataattcatgtattcatgtttattagttttatttggtgtgtaataacttgtcatcaacttagtagcttaatactttaaaaattaattattattattcacccactcttattctggtctgtaaaacaacaccttttaaattcttgtcattattatttttagagatggaatctttctctcttggccaggctgtagtgcattgtgcagtcatggcttatggccacctcaaactcctaggctcaagtgatccttccacctcagcctcccatgtagctgggtgtattagtctgttctcacactgctataaagatactacccaagagtggataatttaaaaacaaagtaggtttaattgactcacagttccacatggttggggaggactcaggaaacttacaattatggtagaagagaagcaggcacatcttacatggcagcaggcaagagagactgagcaagagtggggaaaactgccttataaaaccatcagatcttgtgagaactcactcactatcacgagaacagcatgggagaaaccacccccatgattcaatcacctcctacctggtccctccctcgacacatagggattatggggattacaatttgaggtgagatttgggtggggacacagagccaaaccgtatcactggagctacaggtgtgagccgtcacatcctgcaaaaacagttaatatctgacagtttctgagtcagtaatgaggacaacttagctgggtcctctcttaggatctcataaggtgctgtcaagatgttggctgggctgttttctcatctggaggctggactggagaaggatccatttccatctctctaaggttatgggagattgttgtgtgtgtggctgtagaattcatgttaacttgattttttaaagccagcaacgaagaaagagaaaatctagagctaaccgatagtgagatggaactttagataacataattcaatcaccgaagtgacatctcatcacatatgccacgttttattggttagatgcaaatcataggtccagtctttactcaatgggaggctaatataaaggtaatgaagatgaggaggcagaaatcctaagaatcatcataaaatttgtctaccacacaatggatcaaagaaaaagtctacagaaatctagaaaatattttgaacagaatgaaaatgtaaatacaaaattaaaaaacctgtgggattcaactaaaacagtacttgtatgtaaatttacagaattaaatgcttacataaaatatttaaaagttctcaaataagtaatctaagtttccatctgtgaaaactagaaaaaataaggacaaaatgcacccaaagcaagaaaaagaaaggaaattaaataagagaggaaatcaatacaagtcaaagtgaagtgacaatagaaagaaaatcagtgaatccaaaaaataaccttttggaaagcttgctaaaattgataacgcactagaaagactgaccaaaaaaaaaaaaaaaaaaaaaaaaagagagagagaagacaaaaataagcaaaatcttaaaaaataagtgatactactacagagaaacaggcattcaaaaagagtataatactacacacatatataaatagataaaatagaccagtttcttaatatgtgcaaactacaaaactctacccaaaatgagttctatatttactaaatttccaaaatatgaatctctagtacctcatggtttcacaggtgaattatgtcagatatttaaagaaaaataacaccagtgctacaaaatcctacataattgaaaagtagagaacactttataattcatgacaggaagtgggggaggagagatgggagaagagagagaaggagagagagagagagagaaatgaggagagagagagaggagagccagacagaaatacatcatccaaaaatggtatttgtttacataatttgagaccggttttaatattaaaatttcaatcaatttaacccaaaaaccaatttaaatatattaattgataacagaaaaaaaatttgatgaagttcaacgtcaatttaatataaactctcagcacattcaaatagaagacaatgtcctaaatctgatacagagaaatctacaaataacctaaaactaacattctgttgaaagacaaaaaaactgtatatttttgctgtgatcaaaacaatcaaggatgtccactcttaccacttctatttaacattgtgctaaaagtgcagtaagtcataaaaaagaatggataggcatacagattcaaaagaaatttaataatgtctctattcatacaatagaagattgtctatgtagatgatcccaataaatctccaaaaatccccacatagacctaataaatgagtttgacaaggatgcagaatacaggttcaagtgacaaaatcaatggtatttttatttatcagcaatgaacaatttgaaactaaattttaaaaagctaccactaatactaggtcaaaaataaaataggcatgtagctatcaaaacatgcagaatctacatgatgaaaactgcaaaatactgataaaaaaataaagaccgaaataggtgataaaaaggcatcctatgttcacagtttgaaggattcagcatagtaaagatgttgataatatcctaactgatctacatatttaatgcaattacattaaaaactccagtaagatttctttatagatacataaaagctcgttctaaaatatctattaaggctggatgtggtggctcatgcatctgtaatcccagcactttggggggctgaggtgggagggtcacttgaggccaggagctcaagaccagcctggccaacatagcaaaaaacctgtctctatgaaaaatataaaaaattagcctagtgtgttggtgaacacctgcagtcctaggagaattgcttgaacctgggaggtggaggttgcagtgaaccgagattgcaccactgtactccagcctggtgacagagcaaggctccatctcaaaattaaataaataaataaataaataaataaataaataaataaataaaatgtatattaactagtttaaaagcggaataggaaaaataactttacaaaagaagactgaagttgggggaatcactctatcacatttaagaacttctgtgcagcagtaatcaatacagtatggatttggtaaagacatagatcaatgaaacaggatttggagtctagaaacagatgtacataaacgtggcccactgatttttgtcaatggtataaaggcagttaagtgaatagttgatagtattttcaacaaatattttaaaacaattggatatttgtatgccaaaaatattttacattgagttcaagctaagacttaaaaaaattaactcaaaatgtatcatacatctaaaagtaaaacattaaaacaacaaaatatttagaagaaaacctaggaggaaatctttgtaacctggacataggcaaatatttctgggacatgacaataaaaagttcatatgagcaaaaatgttgataaattaatctttatcaaaatttaaaaactttgctctgcacaatgccttgtgaaaagagtagaaaaataagccacagtctgggagatatttgcaaatcacatacctgacaaagtactcatatgcagaatatataaagaactttaaacacttcacaatagagtatactctcagaaagatggtgtgaggaactccaaatatcttctcccccaaaaccgaaaaagaaaaaataatcaaaattaactattgaaagtctctgaaaattaaacaaaggccatataagttaacaagtattcattaagggtagttaatctctgtaagagcaagaagattccatgtctacctctcccttccccaggtccacagtgtgaaagttctgccctgtgtgggtggggacatctatgagaactactagctctgctgccgtattggagggggctgactttgtttagtgaaaagaatggataaactcttacctagggtatttgttgaaaataatagagatctcatctcagttgttaaaacaatcagtggttaaaacatagcagtgttagttggagaaagcaacaaatctgcagtctagttataaatttaacaggatgattcaggggaagagacagtcaagtaaggctctgtttgaatccctgctgatctgcaaggctgatgcatgcacagggctgtgccacttagaaaagacaggaaaaagtcttaagagatactagaccctggatgaatgtgaggcagacttgtaaaccttctgaattttataagcattcccatgacacagatccaatggcaaatagtagagtcttactagttcaagttatttaatcacaaccgctgaccagttattggctgattgaacaaccactaactaagctgactcagagataaacctttagaaaccagtcttaaaaataaacacaagaaaaaaactgagcaatggtaccatagaccacaaactgtcaaacaaacactccataaaattagtacacacaagtcactaaataaataaacaacaaacaagaaatgataacagtaaaccccaaggtggagtggaaaaaatagaattcatagttgttacattcaattatataaaatgtctgatttttgatagaaaattataacacatgaaagaggaaaacataacccatatgcagagataaatgcagtcattagaaattatttttgagaggtcctagaagttggacttagcagagagagatttcaatgcagccaccattaatacgtttagagaactaaagaaaagctttttaggaccagatggattcacagccaaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatgtccttgatgaacactgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaataacccctcatgctaaaaactctcaataaattacgtattgatgggacgtatctcaaaataataagagctatctatgacaaatccacagccaatatcatgctgaatgggcaaaaactggaagcattccctttgaaaactggcacaagacagggatgccctctctcaacactcctattcaacatagtgttggaagttctggccagggcaattaggcaggagaaggaaataaagggtattcagttaggaaaagaggaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaccttataagggacgtgaaggacctcttcaaggagaactacaaaccactcctcaatgaaataaaagaggatacaaacaaatggaagaacattccatgctcatgtataggaagaatcaatatcgtgaaaatggccatactgcccaaggtaatttatagattcaatgccatccccatcaagctaccaatgactttcttcacagaattagaaaaaactactttaaagttcatatggaaccaaaaaagagcccgcatcgccaagtcagtcctaagccaaaagaacaaagctggaggcatcacgctacctgacttcaaactatactacaaggctacagtaaccaaaacagcacggtactggtaccaaaacagagatatagatcaatggaacagaacagagccctcagaaataatgccgcatatctacaaatatctgatctttgacaaacttgagaaaaacaagaaatggggaaaggattccctatttaatcaatggtgctgggaaaactggctagccatatgtagaaagctgaaactggatcccttccttacaccctatacaacaatcaattcaagatggattaaagacttaaacgttagatctaaaaccataaaaaccctagaagaaaacctacgcattgccattcaggacactggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtggaactgtaaactatttcaatcattgtggaaggcagtgtggcgattcctcagggatctagaactagaaataccatttgacccagccatcccattactgggtatatacccaaaggactataaatcatgctgctataaaaacacatgcacgcgtatgtttattgcggcactattcacaatagcaaagacttggaaccaacacaaatgtccaacaacgatagactggattaagaaaatgtggcacatatacaccatggaatactatgcagccataaaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatgggcacaggaaggggaacatcacactctggggactgttgtggggtcgggggaggggggcgggatagcattgggagatatacctaatgctagatgacgagttagtgggtgcagcgcaccagcatgtcacatgtatacatatgtaactaacctgcacattgtgcacatgtaccctaaaacttaaagtataataattgaaaaaaagaaaagctttttaaaaattaatagtaaaccaataatgcaatgattcatcaaatacagactatcaaagatatagaaattacaaaaagaattacttggaaattctgcaactgaaaagtataacaacaacaacaacaacaacaataaaacctctaaatatttttaagttagcagaagaaagcatcaaggaatttaaaggtagaacaatagagatttttcaatctgaaaacaggaaaaaaatttaacaaggaaaaattaaagacaaatgaacaaagcctaagagatttgtgagactctattaaatatacaagcatatgcatgatgggagtcccagaagaagaggaaaaagaagggaacaaaaatatttttagaaaataatgactgaaaactccctaaatttgatgaagcacattaatccacaaatatcaaaagctcaacaaactgaaattatgataaatgcaaagatctgcacctaggcacatcataagtgcagtggtgaaagtgaaagaaaaagtaaacaacacaaaacaaaatatccttgcagttgacaagagaaaaataattaattgcacacaagagagccataatgaaattaacagatggcttttcattgaaaataatgaaatccaaaagaaaaaggcaatgggatggaatattaaaagtgtaaaagagaaaattgtcaacatgtctttcaaaaacaagttgaaataaattgcaagacaaacgagacaatgcgttatgattaaacctgccttaagtatatactaaaggatgttcttcaggcagaaagaaagcaacatcaaatggttcctcaaatccacatgaagatataaattaaactccaaatacacaagtatgtggaatgtaaaacaacagaaaagctttgaatgtaaaacacaccatgcaaacattaaatgagagtaaatgagtaaaaatacaagaaatgaagtggcaacattaatattagacaaaatagtctttaagacaaaaagttactagagacaaactaggaactcattagaaagagatacagacacaaacatatatgcatctaacaagagaccttcaatatacgtcaatatgcatgaagcaaaaacagaacaaaagggaaatagacaattcaataagaatagttatagacgtcaataaaccacttttactaatagaagaattagaaaatcagcaagagtgtaagagatgtgaacaccattcacctattagccctgtaatttatagaatactcaatctaatagcaccaaaatacatattcttgtcaagggaatatggaatattctccaggataggcttgtctaggctataaaataagtatcaacatttttaatagacaaagatgtatttattctgaagagaaactacaaaaataacaactgtgtgaggtaatgcatttgttgattaactatatttaaccattctacagggtatatagaattatgttgcacatgataggtacatacaattttataatgtcaactaaaaaattatgtcacacgcaataggtagatacaattttataatgtcaactaaaaaataaatttgaaaatttgacagtatcaattgctggttagaatttggaacaagcgcaactctcacacattgctgttatgaatacaaaatggtagtgcagtttcttataaagttaaatatatgttttctatacaacccaacaatctcactcctattttcttgccctagagaaatgaaaacttctgttcacacaaaaaacccatacatgaacactcatagcagttctattcattgcacaaaactagaaacaacccaaatgtcctttgtaaacaaactgtggagcagccatacagtggaataccctcagggatagaaagaaacaaactcttgatacacggattaacttgggtaatctcagagatgttgtggtcagtgaaagtagtagccagtcttaaaggttacatgttgaataattatattaatatgacattttcccaaaaagatcagcctgcagtggtagcaggtagatcagttattcccaggttttaggtcaggaagaggctgtgaatacaaataagagcataaaggctttcctttgtgatgatgaaattgttctgtgtcctggctgtggtggttgttaaatgaactatccatgcattaaaaatcttaaatctgtatgttggcagcaggccccccaaaatctggccataaactggaccccaaactggccataaacaaaatctctgcagcactgtaacatattcataatggccctaatgcccaagctggaaggttgtgggtttacgggaatgagggcaaggaacacccggcctgcccagggcggaaaactgcttaaaggcattcttaagccacaaacaatagcatgagcgatctgtgccttaaggacatgctcctgctacagttaactagcccaacctattcctttaatttggtccatcccttcgtttcccataagggacagttttaattaattgaatatctatagaaacaatgctaatgactggcttgctgttaataaatatgtgcgtaaatctctgtttggggctctcagctctgaaggctgtgagacccctgatttcccacttcacacctctatatttctgtgtgtgtgtgtctttaattcctctaggaacctgggttagggtctcctggaccgagctggtcccagcatctgtacatcaatcaaaataaattttactgtgtgtgaatgtaaaaatgacattatgtgattggaatacatgattcattaccatgaaatcaaatttgtgatttcttatattagacattcttgattttaaaatgtttacgtaaaaaggtttaccatgtaaacactaatcagaagaaaagatttgctatataaatatcataaaaattagacttaaagacatgtattattaaatataaagaaggacatttgataatgataaaagggatcagttcacaggaagacataacaatcctagattttaattaacattgcttcaagttgtacagtgcaaacttgacagaattaagatgagaaataatccacagtcatagttgcactataacataccactctcagtagccaataaaacaggaaggcaaaacaacaataataatgaaacttagttaagataaagaagatttgaacaacatgattaaccaactttctgtaattaagaggagcgtttcatcaccatcacgtcagataatggcaacaattctatttattttgacatgttatgtgtacatgtgttgctaaaatgtttttccttaaacattaacaaatccaatcagtggaaccacatccagatagcaaataaatagaaaatactgtgtcattagatattgtctattatataactccagtgactcacaggaatgaatacatatagtaaacctcagtgtgagttctgaggggccaggttactgctaagggagagtcattgcccaggcttctatgagtaaatcaccaatggaataacatattaatgagaaagcatgtgaatattcaggttattgtacaaaatgcaacagtggattactctcatcctgctttacaaataagttacatttcccttctcattattaaatgtatacttttgaaatacagaagaatatacataagaaaatacaaattctccacaatactgccactaaaggacagaattgctaaatatcctggttcatttttcatttcctttcacaattttattttgcatatgcaaatatatatgcatacattatatcattatggtttttatctgtaatctctacaacttgttaatattttactgtatgtccttttgcatatcaatatcctgaaaacattattttatatcactgattaatgtatattctaagacatagaagtctattttgaaactgtattgttaaaaatttgcaaacaataaaatatttctttgcatctttattttttatgggcagacacacagaggtgaagctgctgtgtcaaaaggaattagtaatttcagtgtactaattgccaaaataatttctcaaatggttgttctgatttctatttcctccagcagaaaattagaatgctcacttctctgactttcttcatcattgcattaccataaaatatgattgcctatttttaggtaaatgtgcatttctttaattattgtaaaaatgttttgtctatgtaaccattttatttttctaaaattgtcatcttttgcatatttgtattgatattttcatattgattcataagaactaattttaaggtaaaatattaattctgtctttcatttaatcataaatacttaaaggtttgctttatcatctaattatgcttaatataatgctttagttatatagtcttatatagtcagattaatcaatgtttttccctgtattctgatactcttgtgtttagagatttttttcccaggtaaaatgaagaccttaatgataatatttttgttttttatgattttattgctacagtttattctgtgagatatttatgttagtgctcagtgcaaagtaggattctaactttatttccaaataattagctaaattccaaatttcgtattttgggaaattatacttttcttattggtttgtagtactttctttgtaattatctcatattataaccaagtagtttaggttcaaaacacattaaaaatttttttctttcttttttctcctttcctcctagtctcaagacttgaagcaaatttcagaagcctttttttccctccttagtcttaaaatatagcttgaagtgtactttttaaaactctacatccctccctttcccaccatacacttccttacactatgcacatttatctaactgtatgcttgtgaagcttacaccatgcacacttatctatgtgcttacttgggagttccagggactaatcttgagacacaccaagcatggagacccagttgcaaaattctgaagattacttcatggtagttagtcaacaacccagccattgttgagacaatgccagcctgagttccaggtggactgcaactcaagatagccaccggaataagacacacagactttgtacccagcacaattcccacatgcttcccgtaccaagttccgttttttagcccctctccccaacctaaagtttgaaatggtttctttaaggcactaaccttggccatttccctatggctgactctagattaaagtcactttccttctgctgtgcttcttccttgtttaccagctttatacatagcaagcagacaaccttgcttttgattataatatatgaaagaagttcatgtgtaatgaacttggtattaaaatgtttatgtaaaaaggtgtttaccttgtaaacactaaccagaataaaagatttgctatataaatatcataaaaattagtctttaaggcatgtattattaaatatagagagagacatttgataatgatgaaagggatcaattcacaggaagacataatcctagatttgaacttcttacatatttacatataattattgatatcaacaatcaatttgactgcagattcttgttcatattccaaatgttttcatttattgtaatgttatagtattttcctatctcattggacaattttcttcattattattttttattagtagtaaatatttcttggttaatctcagtagcttataatcagaaaacttttagacaattaataatttaagttccatcaaacttctactatggttttgttggaattacagtgaaactaaaaataactggtatacttttaccgtttaatcttttcagtatgtgttttctattttctagtacgtttgactttggacaacatgagtttgaactacacaggtccacttatacgcggattgttttcagtaaaattacaccaagtgtgtctgtctctcctgtttctccttccacctcctccacttcaccctttgctatcccttagacagcaagatcaacccctctttcttcctcctccttctcagcctactcaacaagatgatgagaataaagacctgtatgatgatccactttcacttaatgaatagtatattttctcttccttatgattttcttaataatatgttcttttctctagcttactttatcataagaatacagtatataatacatataacatacaaaatatgtgttgactgtttatattattagtaaggcttccagtgaagtaaatagtaaagtttcgtggggttcaaaattatacacaattatttttactgtgcagggctcagtgcccctaagtcctgcattgctcaagggtcaacagaatatagatatgtctctctctctgtgtgtgtgtgtgtgtgtgtgtgtgtgtgtgtaaagtttacttcatatagttctcacatattatatttgcagataaatattgtttattatgttaagaaatactgtatattgtagttcgccaagaattctatcaggaatgggaattgagttatcacaaattatttcagaatccacttagatgatcatatacttatttttgaaattatgtgttaatagttttcagtatttagccatccacactccttaggttaccttttctgtagctgttttctttctccctttttttcttttctattctatttagaaacctatataattgtatctctgacaaaggtattttcaataagttacaatgtttggtaaatagaatgatctatatcaacgagctaaatagtgtggaagtctgagaaaagagtatctattgattaccaaacttaggcaattaggctgtgatttttttttacatacaggtagtctttgctttgcaaaatggtacttggaaatcaaaatgatcatataaactgagaccatgcaaagtgatctaaataatcactgggaaaaatacaattttcctgtaatctttaacatttttgataaaagatcagaaactcccttactctcagttataaatacatagagaaatgaaaaacagaaaaacatttttgtagaatataattttaaaacattagaaacaatgagaaataaaacattttatttctttgtaaaaaaaaagtatcacaaatagtttgaacagaatttgccttcttcttgccatataagattatgcagagcaagcatcgtttctatgctttgacaaagcattctccttttttctaaatttgaattatcttccaacattttatcctttgcactttcaaagtggtgaactatcttgaagagtttcttttttatttttttatgtgaagatttttgctgatgccactttcctctatgatggcttcacccttttgtcactaccactttcttcctttaggttgataagttcacctttcataattccctcaggctgcgaatctagaatctgaagagtaaaagtatcaacattccctccatcagttattcttccataactgcatttacattggtttcaaattttacttccagcattatcacttctcaattctttttaatttcttcactctactttcatctttgctgaccagcccctctttctttagctatgattattattattattgagacaggttcttgctctgtcacccaggctggtatgcagtggtgcagccatagctcactgtaaccttaaactcctagtctcagttgatcctcccatttctgcctcccaaagcgctgggattacaggtgtgagccactgttccaggtcttgattagccatttttaaaaatggcatgtgagtttaacactggaaagcacttgggcaatacaactatgtgcttttctgtttgtgcatgaactgaatgaacagatcagtaaccaatcagtgacagattttgaaagaaggaatgtgattgctcattgattatgatgttaatctgttatttgtagagtggttcatagactgaaaagctagcagctaagtttatcctttatgcaaacactcacagttaatgtgtgagttaatatgacgtggtaactgaaatgtgagccatgttgttgggggcacttgtgttatttatttatttatttgtttatttatttatttatttatttatttatttatttattttgagacggagtctccttctgttgcccaggctagagtgcagtggcgccatctcggttcactgcaagcttcgcctcccgggttcactccattctcctgcctcagcctccggagtaactgggactacaggcgcccgccaccacgcccggctaattttttgtatttttagtagagatggggtttcaccacgttagccaggatagtctcgatctcctgacctcgtgatccgcccacctcggcctcccaaagtgctgagattgcaggcatgagccactgcgcccagccggcacttgtgttatttaactaaacattggtaactcaaatttgtgtgcagtgagaagtacatgtttagacttgataacttttaatgcaaatatgtatttattctatctttagtataagtattctatttgtgaactaaaactttaaagctagtatctttttgtttccagtgagtcctgtttcactcctcctctttaaaggtttcatcagcacttgctctgtgaatggtgaacggggattgccagtaacttcttatgtaggaaagatattgcattctgttattttaaaagataatattgaattatactactattgtttgattctgaaatactactgtcttcaatatgaaactagattatgtaaacctttgtggaagatatatttaacttataattttaacaagtaaaacattttaagctaatggaatcataattagtagttaaagaaatttgaatgtattttacatcatgtagttagctatgggaaaaaaaaacttttacatattcatttattttgaaggtataaaagtcaatacacatggtactatgacttttaaaaatttacttcatttatacacctgggatttggattaatagtacttatacaatataaatactcaatttcataagtgcctagcatcttttgtttgatttcttcaaaacttttatttatgctcatttgaaaagtctcaaatctttttctccattgatggttcaccttaatttgaaggtgatcattatccatgagattatatagagtatttatatgatttttaaaatttaatattagcaacacaatttatcagaggatattttcttttcttttttttctttttttggtaaaataaagaacattaaaaacacttctggaactgatggactttatgttaagtgaaataagccaggcacagaaaagacaaatttcacatgttcttactcataagtgagaactaaaaatttttaataatgaactcatacagtcaaatgatagttactagaagatgaataacataacagtgtgactatagttagcaataatctattgcatattttaaaataaaataaaagagtggaattgagatgttcctaacacaaagaaaatgacaaagaaattgagtaatgaataccccaattaccctgatttgatcattgcacattgtatgactgtataaaaacatcacatgtaccccccataaatatgtataattattaggtacccataaaattaaaaattaaaaataaacaaaaacacttttgcaacttctgtttttctgttctaacacaataaatacactctcacttgttatgtgttctcatagttaccatgcactctacttattattcattcatttagttgatacacaagtcaaaccttgttttcatggaaattctaacactataggggagagaggcaaaagtaagtattacagatggtccaattacatagtattttaggaggtgatacatgtaataaaaataaagcaattttatataatagtcagggtccagaagcagtatagggaatgaacaacatggctgtttggaggaagaatattttctacagagtgcaaggtcctgaggtggaaacttgcctagtatgctgataaaatgaaggagaacagtgatggcggagcacagtggggaagtggtagtaatagaaaagattacagagtaacaaaggaccagctagtctaaattcttgtaagtcagtgtaaggacttcagtttctaccctgagagagctaaggagccattgaatgatttgtagaggagatatattgtgattccattgctaataggttcactctggctgttgcactgagaacaaacttaagggaaacaggagtaagggtaagaaaaccagttaggtgagtattgtagtaatttaggtgaaaaatgatattggctcggactaaggtagcagcagtaggagtcttaagtgattagattcaacatataatttgaaagtagacatgactagatttgctgatggattggatatgtatgaaagatgagatgagccaaggatgcttcctggagttttgacctgaggctcatattttgacctcagaagatggcagtaggagtacgttttagaggaacgtcaggaactctgttttggatgtgtaaatctgagatgaccctcagacactcagatggcgatgttgaggaggctgtcgtatttaaaactctggattactgacaagggttttaaactagaggtattaattattatatataatttcatggaattacgagccatatctactttgtttatttcagtgtgccccatacctatacaacatctagtacttacaaggtacttgagaaatatctgttgagtgagtgaatacacaaacagcgagtcatgtgctggtaaatgattttaatcacaggtactcctggataaacaacaaaaaacacaactcctgatttgtagtgtttccagatttctgtggtgtaaatacttctcccatgacttaaagctatcaaagtagtatcatcgaatattactttgtattccagttgggaagaaatgtgcacaactgtttccttctaggtggtataaacaggctctagaacacaactgggcccactgttgattagtgatataatcatagacatactttcccttacttacaggagtgtgtaacagataattttaaatagtcttgatacttgggcaggtgtgaaggagaaacatcttatagatgataatacaagctcaaaataatgaacttaagcaaatattaaaatcctgtgtgacatagcacaagaaacactacaaacactgtgctaatttatccctgtagccttcaggcaggcttctattactccaaacaggtgatgtctccttatacaattctgggggaaattattttactgcttacaacatattatgatgttaccaggactctcttgccagaactgtctttacaatttatgtcagacatcaaatgtgtttttaaaatgttgctgtaccaagatcaagtgggcttcatccctgggatgcaaggctggttcaacatacacaaatcaataaacataatccagcgtataaacagaaccaacgacaaaaagcatatgattatctcaatagatgcagaaaaggcctttgacaaaattcaacaacgcttcatgctaaaaactcaataaattaggtattgatgggacgtatctcaaaataataagagctatctatgacaaacccacagccaatatcatactgaatgggcaaaaactggaagcattccctttgaaaactggcacaagacagggatgccctctctcaacactcctattcaacatagtattggaagttctggccagggcaattaggcaggagaaggaaataaagggtattcaattaggaaaagaggaagtcaaattgtccctgtttgcagatgacatgattgtatatctagaaaaccccattgtctcagcccaaaatctcctcaagctgataggcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctacccatgactttcttcacagaattggaataaactactttatagtacatatggaaccaaaaaagagcccgcattgccaagacaatcctaagccaaaagaacaaagctggaggcatcacactacctgacttcgaactatactacaaggctacagtaaccaaaacagcatggtactggtaccaaaacagagatatagatcaatggaacagaacagagccctcagaaataatgccacatatctacaactatctgatctttgacaaacctgacaaaaacaagaaatggggaaaggattccctatttaatcaatggtgctgggaaaactggctagccatatgtagaaagctgaaactggatcccttccttacaccttatacaaaaattaattcaagatggattaaagacttaaatgttagacctaaaaccataaaaatcctagaagaaaacctaggcaataccattcaggacataggcacgggcaaggacttcatgtctaaaacaccaaaagcaatggcaacaaaagccaaaattgacaaatgggatctaattaaactaaagagcttcagcacagcaaaagaaactaccatcagagtgaataggcaacctacagaatgggagaaaattttcgcaacttactcatctgacaaagggctaatatccagaatctacaatgaactcaaacaaatttacaagaaaaaaacaaacaaccccatcaaaaagtgggcaaaggatatgaacacacacttttcaaaagaagacatttatgcagccaaaagacacatgaaaaaatgctcatcatcactgaccatcagagaaatgcaaatcaaaaccacaatgagataccatctcacaccagttagaatggcgatcattaaaaagtcaggaaacaacaggtgctggagggaatatagagaaataggaacacttttacactgttggtgggactgtaaactagttcaaccattgtggaagtcagtgtggtgatttctcagggatctagaactagaaataccatttgactcagacatcctattactgggtatatacccaaaggattataaatcatgctgctataaacacacatgcacatgtatgtttattgcggcactattcacaatagcaaagacttggaaccaacccaaatgtcaaacaatgatggactggattaagaaaatgtggcacatatacaccatggaatactatgcagccataaattatgatgagttcatgttccttgtagggacatggatgaagctggaaaccatcattctcagcaaactatcacaaggacaaaaaaccaaacatcacatgttctcactcataggtgggaattgaacaatgagaacacatggacacaggaaggggaacatcacacactgggacctgttgtggggtggggggaggggggagggatagcattaggagatatacctaatgttaaaagacaagttaatgggtgcagcacaccaacatggcacatgtatacatatgtaacaaacctgcgcgttgtgcacatgtaccctaaaagttaaagtataataaaaaataataaaataaaataaaatgttgctgtaaaaaatatacctcaaaagtatttaaacaaagtttaatcaatttgtcctattttggagtccacattgttttgcatgtatctcagagtcattatattttaaaagtgttcattttaattaattttgtttttaaaatttattgtggtaaaatatatataacataaagtttgccattttaaccattgtaagtgtacagttcaatggcaataagtacatttacactattgtacaaccataccaccactcatctcagaactttaataattatttgacattatttggttttgtgtgaaagaatagcattttgttgtagatgatgaaaaaaagaaaactataaaagaaaataaaattatccaaagtctcaacattcagagaaaattcaatccatattcacctcatggcacatataaaactatatcggactgttaaatccatggtctaaaaatttctcatgtgttaaaaatcctgctgagtctagaattagattaagaatctgactgtgtctaatgaagtggtggagctgcaaaccccagttgtctaatctgcagcatttatttaatataccaatgaggaaacctcaataaaaatgatttatgctcagagtgatgaggcatagggaagaaagggtatgcacaatttctcatgctggacatttgatttagaactgaaccctatgatgagagaactgcaagtagaagatgaaggaactttgggtattaagaaattggtaatacatggccggccgtggtggctcacgcctgtaatcccagcactttgggaggctgaggtgggcggatcacgaggtcaggagatcgagaccatcctggctaacacagtgaaaccccatctctactacaaaatacaaaaaaaatttagcagggcgtggtagcaggcgcctctagtcccagctatgcaggaggctgaggcaggagaatggagtgaacccggcaggcggagcttgcagtgagccgagattgcgcccctgcattccagtctgggcaacagagtgaaactctatctcacaaaaaaaaaaaaaaaaaaaaaaaaaaaaagaaagaaagaaaggaaattggtaatacatttagcaacatgtagggatgagatattcttccatattctatttagaatacaataggcttcacaaaaatgtcatgctgagggcaaagtttgtaacttgtgaatcttgcagatttggatgcaatgtgttaaaaatagcaatatggaaaaggagatggcatcctactccagtgaaatggtcatactctttatggaagtgttgacattgctgtagaagtactgtgttagtttgttttcacaaggctataaagatactacccaagactgggtaatttataaacaaaggtttagtagactcacagttctgcatggccagggagacctcaggaaacttacagtcatggcagaagaggaaacaggcacatcttacatggtggcaggtgagacagagcaagcaagagcagggaaaactgttttataaaatcatcagatcccacgagaactcactcactatagtaagaacagcatgggagaaaccagccccataatccaatcacctcatacctggttcctcccttgacacatagggattatgggggttacaattcaaaatgagatttgtgtggggaaacagagccaaaccataccaagtgctaaagaagactactgataagttcttaccactatcctctccccgactatcctcactagggacactgaaataattaggacactatagcaagaaatggtttataagtaaaagttatgaatcaaagaaatttaaatattcatgttaacgttaccatatttatacacaagggcatggagacttggaagaattgtggctatattcaaatatgtaattttttatttctacataaaatttcgtttttggatgctctataatttgttagatcattttcttttcttgggaattttagttgttttcagttctttgcattttggtttgaaaactatctttaaatatgagtttttattaaaaatctattattatttcttaaaaattaaatcctgagtagaaaaaatgactcaaaggatgtatgaattgacaatcaccctcctaagagatttttaccaatttatatccaaatgttaggataaactatataaaatactaattgataattttaaactgtaaaaattgcaatttcataaaaaatatgtgtaaaaatgcctgtttcattgcatgcttaccaacctcttatcatttttcttacataaaaagtggtatttcatggccttttcattcatttatttacttttataattcatttattcatcaatccagagtgcatccttactatgttcaaaccagtatgacaggcatgagaatgcaaaggggactaagaacattcagcctgcctttatggtacttacaagtctcttagaccaaattatcaaccaaacagtcttaaacagaaacataaaatttatatttcataaataaatataaatatgaaaatgttatgattgtcatgtgctatgggaatctataaggaaacagctaatttatattgggagcatcatggaaagtgtctctgtaaaagtgacgtttgaactgttatctaaaagaggagtacatttagctaatgaggaattggaagaagagaatttgagggagaaggaaaactgtgtattcaaagattttatggcaaaaagataggatcatccatttatgaacttgaaagaggatctgagtggttgaaacagagattaggccaattgaattatctaatgaaattttactggattaagaatattattcttctcataagtgcaatggaaacgttgtaggattctaaataggggtgtggaaaatattttctcatgtatgttttgaaaacataattctgtgttgcaatatgaacacattagggtaggttaagcctggatgcggggagaccaattaggcaattttagtagaccagaaaagacatgagggtggcttggagtagggaagtgggagtaaaggcagaaaaaatgtaatagatttgtgagttatttgaacaactggatgaatgcttgcactttttattgaaacactgaaagagggaaatatctggaggtaagatgatgggttttgtggaatttaaagggcctttcagacatccaagtagaaatgtcaaggaggtaactgagtatacatgaccacacatcaaagaagtgttaccaatggaattttatatttgtgaattatttgcttctttgagttttaagccaaatacatgaattatctattaaaaaattgaactaaattttatagaataaaacaagtctgtatatcctgatgctaaagtatatctaagatctataatttgtcaaataaatgtttaataacagcatgttaattcatatgacataattttatactgttttaataaaggaaatatatctgtgtatatatacacacacatatatacacagatatatatagatatgtatgtatataatgtactatacatgagtgcatagggagagaaagaaagtacatataataaaaaactggggggagcattgcaatgtggatgtgacggtcataggttggtgatatttagagggtaggataacaatgggtaaaagttaaatttaactttctaatacttatatatttttgttttttcactgtgaatgtgtggctcttacaatgaataagaaaaaatatgtttaagtataagactgggaaggacgatgaatcaggatcagcaactggggactgggataaaatcgattccaagagcttttgccatatattacaactttgagttatctgcttcccaagctatatccaaagttcaaatgagacaaaaagatacttcagtagaaaatatgctttatcctttcttgcagttttatctttgtatcaaaccagaccatctggaatctttgctcagatacatgtttagtacctgaaaatgtcgttcactgagttccactctggtaccatggctttggcccactcggtggaatgctaaataaaaatacacaggaaacctgcttttgcatttatgacagtgtatttgaggatattttcttctttttactcatacaaataattccttgaaactcaagtatcagaaattctttagcacttaaggaatgtgtatgtactgtctttacagagagtgtaaacaatattactaattttacatacttttttgtataattatcaagagactcagagacatatttgaagtttaacttttataagaaattaagactgtttgaccccaatgtctactttacaaatttactttggcatgacttcatatatataacaacctggtcttgttttatattgacgtatttttttctccaatcttaattttttattcatttatatttgtctgttcattgtatagattcttatgtgtctataattcagaagaaaatcaataagacacagttccaagatggccaaataggaacagctccagtctacagctcccagtgtgagcgacgcagaagatgggtgatttctgcatttccaactgagttaccgggttcatctcactggggtttgtcagacagtgggtacaggacagtgggtgcagcccaccgagcgagagccgaggcagggtgaggcatcgcctcacctgggaagcacaaggggtcagggaagtccctttcctagtcaagggaagctgtgacagacggcacatggaaaattgggtcactcccaccctaatactgcacttttccaatagtcttagcaaacggcacaccaggagattatatcctgcgcctggctcagagggtcccacacccaaggagccttactcattgctagcacagcagtctgagatcgagctgcaaggaggcagtgaggctgctggaggggcacccgccattgctaaggcttgagtaggtaaacaaagcggccaggaagcttgaactgggtggagcccactgcagctcaaggaggcctgcctgcctctgtagactccacctctgggggcagggcatagctgaacaaaaggcagcagaatcctctgcagacgtaaatgtccctgtctgacagctttgaagagagtagtggttctcccagcagggagtttgagatctgagcacggacagactgcctccttaagtgggtccttgacccctgagtagcctaaatgggaggtacccctccagtaggggcagactgacacctcaaacagccaggtaccactctgagatgaagcttccagaggaacgatcattccagcagcaacatttgctgttcaacaatatttgctgttctgcagcctccactgctgataccctggcaaacagggtctggagtggacctccagcaaacaccaacagacctgcagctgagggtcctgactgttagaaggaaaactaacaaatagaaaggacatccgcaccaaaaccccatctgtatgtcaccatcatcaaagagcaaaggtagataaaaccacaaagatggggaaaaaacagagcagaaaagctgaaaattccaaaaatcggagcacctctccccctccaaaggaaagcagctcctcgctagcaatggaacaaagctggatggagaatgactttgacaagttgagagaagaagccttcagatgatcaaacttctctgagctaaaggaggaagtttgaacccatcgcaaagaagctgaaaaccttgagaaaagattagacaaatggctaactagaataaccagtgtagagaagtccttaaatgacctgatagaggtgaaagccatggcacgagaactatgtgacaaatgcacaagcttcagtagccgatttgattaactggaagaaagggtatcagtgattgaagatcaaattaatgaaatgaagcaagaagagaagtttagagaaaaaagaataaaaagaaatgaacaaagcctccaagaaatatgggactatgtgaaaagaccaaatctacctctgattggtgtacctgcaagtgacggggagaatggaaccaagttggaaaacactctgcaggatattatccaggagaatttccccaacctaccaacgcaggccaacattcaaattcaggaaatacagagaatgccacaaagatactcctcgagaagagcaactccaagacgcataatcgtcagattcaccaaagttgaaatgaaggaaaaaatgttaagggcagccagagagaaaggtcgggttacccacaaaggaaagcccatcagactaacagcggatctcttggcagaaactctacaggccagaagagagtgggggccaatattcaacattcttaaagaaaagaattttcaacctagaatttcatatccagccaaactaagcttcataagtgaaggagaaataaaatcctttacagacaagcaaatgctgagagattttgtcaccactaggcctgccctaaaagagctcctgaaggaagcactaaaaatagaaaggagcaactggtagcagccattgcaaaaacatgccaaattgtaaagaccatcaatgccaggaagaaactgcatcaactaacgagcaaaataaccagctaacatcataatgacaggatcaaattcgcacataacaatattaaccttaaatgtaaataggctaaatgctccaattaaaagacacagactggcaaactggataaagagtcaagaaccatcagtgtgctgaattcaggagacccatgtcacatgcagagacacacataggctcaaaataaagggatggaggaagatctaccaagcaaatggaaaacaaaaaaaaatgcaggggttgcaatcctagtctctgataaaacagactttaaaccaacaaagatcaaaagtgacaaagaaggccattacataatggtaaagggatcaattcaacaagaagagctaactatcctaaatgtatatgcacccaacacaggagcacccagattcataaagcaagtccttagagacctacagagactttgactcccacacaataataatgcaagactttaacactcccctgtcaacattagacagatcaacaagacagaaagttaacaagggtatccaggaattgaactcagctctgcaccaagtggacctaatagacatctacagaactctccaccgcaaatcaacagaatatacattcttctcagcaccacgttgcacttattccaaaattgaccacaccgttggaagtaaagcactcctcagcaaatataaaagaacagaaattatagcaaactgtctctcagaccacagtgtaatcaaaatagaactcaggattaagaaactcactcaaaactgctcaagtgcatggaaactgaacaacgtgctcctgaatgactactgggtaaataactaaatgaagtcagaaataaagatgagaacaaagacacaacataccagaatctctgagacacatataaagctgtgtgtagagggaaatttataccactaaatgcccacaagagaaagcaggaaagattcaaaattgacaccctaacatcacaattaaaagaactagagaaggaagagcaaacacatttaaaagctagcagaaggcaagaaaaaactaagatcagagcagaactgaaggagatagagacacaaaaaacccttcaaaaaatcaatgaatccaggagctggttttttgaaaagatcaacaaaattgatagactgctagcaagactaataaagaagaaaagagagtggaatcaaatagacgcaataaaaaatgataaaggggatatcaccactgatcccacggaaatacgaactaccatcagagaacactataaacacttctacgcaaataaactagaaaatctagaagaaatggataaattcctggacacatacaccctcccaagactaaaccaggaagaagctgaatccctgaatataccaataacaggctctgaaattgaggcaataattaattgcctaccaaacaaaaaaagtccagggccagatggattcacagccaaattctaccagaggtacaaggaggagctggtaccattccttatgaaactattccaaccagtagaaaaagagggaatgctctctaactcattttatgaggccagcatcatcctgacaccaaaccctggcagagacacaacaaaaaaagagaattttagaccaatatccctgatgaacattgatgcaaaaatcctcaataaaatactggcaaacagaacccagcagcacatcaaaaagcttatccaccatgatcaagtgggcttcatccctgggatgcaaggctggttcaacatacgcaaatcaataaacataatccagcatataaacagaaccaatgacaaaaagcacatgggttatctcaatagatgaagaaaaggtctttgacgaaattcaacaacacttcatgctaagaactctcaataaattaggtattaatgggatgtatctcaaaataataagaggtatttatgacaaacccacagcacatatcataatgaatgggcaaaaactggaagcattccctttgaaaactggcacaagacagggatgccctctctcaacactcctattcaacataatgttggaagttctggccagggcaatcaggcaggagaaagaaataaagggtattcaattaggaaaagaggaagtcaaattgtccctgtttgcagatgacatgattgtatatctagaaaaccccatcgtctcagcccaaaatctcctcaagctgataagcaacttcagcaaagtttcaggatacaaaatcgatgtgcaaaaatcacaagcatacttatacaccaataacagacaaacagagagccaaatcatgagtgaactcccattcacaattgcttcaaagagaataaaatacctaggaatccaacttacaagggatgtgaaggacctcttcaagaagaactacaaaccactgctcaatgacataaaagaggacacaaagaaatggaagaacattccatgctcatgggtaggaagaatcaatattgtgaaaatggccatactgcccaaggtaatttatagattcaatgccatccccatcaagctaccaatgactttcttcacagaattggaaaaaaactactgtcaagttcatatggaaccaaaaaagagcccgcgttgccaagtcaatccttagccaaaagaacaaagctggaggcatcacgctacctgacttcaaactatactacaaggctacagtaaccaaaacagagatacataccaatggaacagaacagagccctcagaaataatatcacacatctacaaccatctgatctttgacaaacctgacaaaaacaagaaatggggaaaggattccctatttaataaatggttctgggaaaattggctagccatatgtagaaagctgaaactggatcccttccttacaccttatacaaaaattaattcaagatggattaaagacttaaatgttagacctaaaaccacaaaagccctagaagaaaacctaggcaataccattcaggtcataggcatgggcaaggactttatgactaaaacaccaaaggcaatggcaacaaaaggcaaaattgacaaatgggatccaattaaactaaagagcttctgcacagcaaaagaaactaccatcagagtgaacaggcaacccacagaatgggagaaaatttttgcaatctactcatctgacaaagggctaatatccagaatctacaaagaactcaaacaaatttacaagaaaaaaacaaacagccccatcaaaaagttggcaaagtatatgaacagacacttctcaaaagaagacatttatgcagccaaaagacacatgaaaaaatgctcatcatcactggccatcagagaaatgcaaatcaaaaccacaatgacataccatctcacaccagttagaatggtgatcattaaaaagtcaggaaacaaccagtgctggagagaatgtagagaaataggaacacttttacattgttggtggaactgtaaactagttcaaccattgtggaagacagtgtggcgattcctcaaggatctataactagaaataccatttgacccagccatcccattactgggtatatacccaaaggattataaatcatgctgctataaacacacatgcacatgtatgtttaccgcggcactactcacaatagcaaagacttggaaccaacccaaatgtccatcaatgatagactggattaagaaaatgtggcacatatacactatggaatactatgcagccataaaatatgatgagttgtcctttgtagggacatggatgaagctggaaaccatcattctcagcgaactattgcaatgacaaaaaaccaaacagcgcatgttctcactcataggtgggaattgaacaatgagaacacatggacacaggaaggggaacatcacacactggggcctgtcatggggtggggggaggggggagggatagcattaggaaatatacctaatgtaaatgacgagttaatgggtgcagcacagcaacatggcacatgtatacatacgtgacaaacctgcacattgtgcacatgtaccctggaacttaaagtataataataataataataaggaaaaaaaagacagaaaatcaattagacagaaaaaaataggagctcttcaatcacagtggaaaataaagtcatggttctggatgagattggttggggacaggaaataaagaagaagaaaacaggcccagaacttagtataaagcaacttttgcatttaatcattatgtataggcagagattcagaaatacagccaaagaagagaggctaaggaggaaggatatcagaaaagttggaagccgagaggtgagacttctaggcagtagccacctgtgaggaatattgctcatgggtcaaagaagtcaaggactgaaatgtccactggatttctcagtgtggctctttggacagtgttgggaaaataatgagatttgagtggctttaagagcaaatagcacataaggaaatgaaaatatgggatataagcaaatgatactttcatgcttgttagacatttttcttttttttggattttgtttatgtcttttgttctttttacactggggatatactttttctttaataaataagaatatgttatatattaaggatttttatgcctgttaaatatgccataaattcttgtttgacatacacttttctgttgtggttaatataaccttgatatcagccggagttcagctagttataaaagagcaacctctgattacatatgattctgtgataatcttattacccattcaattaatatatatttattgctttcactatacgctcacaattttataagaattggcactataattttaactgaactttgacaactcactagagcagtaattttagtggatgcaaatgggatattttaaaattattgaatgagaattacaaattttagaaagagccaaacagttatgataagtttcctgaaagttaattttaccatagttttagttactattttgtaaataattcaaaaatatgtaacagttgatcttaggctaaaaagttcatcatttgcggtaactagtgatagtgagtcaagtataactataacactaataaagagtattaactgcatggaaagtgacttttcctagagtgcagagaaaggatattgcacttggtactcaaattaaagaccgaaaaaggattttttaaaaatttagcagagttcatatctataatgttggtaatgatgcaaaatttaccacaatacatttagataatctgttactagattaagacctcagtatttctcatgactctatatttttattcgttcagaataattttcaaaagctcttcctagaggatctttgagtactttgcataaattaggtttatgtaaaagtgaaatagaagattaccaaataaattaaaaacaacaaagggtagcatagaagaccaatttttatctacttggccattactattcttacacagttttgttgaacgctccttttaataattattcatgtaaggtatgccactggatttacagaacaacttttttgctatctttcttaaagcttttgaacaattagataaaacagtaattactctttgatatggtttggatctgtgtctccacccaaatctcatgtcgaattgtaatccccaatgttggaagtggggcctggagagaggtgattggatcatggggtggatctttcatgaatggtgaagcaccatgctcttggtgctgtctcctgatagagttcttgtgagatctggttgttcagatgtgtgtagcacattccctctctcactcttggtcctgttcctgcctgccatttaagactactgctcctgctttgtcttctgtcatgattgtaagtttcctgagacctctccagaagcagaagccattatgcttcctgtatagcctggggaaccatgggccagttaaacctcttttctttatcaattacccagtctcaggtatatctttatagcaatgtgagaacagactaacacactcccttaaggtttacaagaaacagtgtatgtggtttaaaaaaatatttaattaaatactcagatcaatactggatcatatgccctgaaattttcatttactatatgttataataaaacttcctataatttctaacctaatctcaaagcatgtgcttagaaaatgaaagaaaatatgtaactattttctaatatgaccatacatcaagtactatatgccgtaaatgaatggaaatcaaaatatttgtattgtaataactgttctattaataattttctaccttctactttctcaagtaaaacatagaatatatatatatgtaagatatgttatatatacatgtaagataaacagtttaaactagtactaaattctaatttgattaaaggtaatgactttgtctaatcaaaccctgcagtcatcacaacttgttaggtgtcataatagtgtagaggtgaagagaatcactggccctggagctaactgcagtgatttgaatcttgactgtactgcataatcttggaaaagcttatcatctttgaggcaagtgttacatttatatgttatttttcaaaatggcaaattggggaaggatggtggagagaaaagcaactcttcactgacaaataattttatcttgtgtgtgtgtgtgtgtgtgtgtgtgtgtgtgtgtgtgtgttggaggtataggggtgaggagacaggtactggtagtggtaaagtagacttctaggcaagaaggaaatgtgtagaactagaagatggatttctggcaaattagaaaacagtttcgcaggactttgtagcaaatcagaagttaatgtgcttcagaataagaccagaactggtgatctcacagtcaaatctagtaaacttactaatattatttaaatcgtgaaaatagaaagtaagtaatttttccagtacaaaatgagtgctgaacacttcaaggaaaactcaatgccttttattataacaattgtgtgaccattagcttaaggttctccatttgtaagatacaggcgttcattgagggaatatctgtcatttctcagagtcataagaggctgcaaccattttgctacagctgaacaaaagccatatgtgcccaagtcaaagttgcaattattttcaagatcacgggtcttttgattttaggcacaggaacaaagcgaattgaatatattttccatttaggctaggttgatataattcagtttatattcagtggggatagaaaacactcaaaattaaataattgaagttttcacacttcaattgtagtctaaattgggaaatatatactgtttactatattcttagctaaatgagtcagtaagtccatgcagaaggcaccatgattcagtgtcaacctcagaaaggttttctttaacttataaaatatatcctataaaatgatggaaaataccacatcattcaggtgtcaacctcagaagcgttttctttaacctataaaatgactgaaaacagcacagggtcagtttttacagttcatgtttgataagacaccaatgcagaaagattggtaaactattggactggtaatctattgagagttttaataattgttgtattttgtatactttttgattctaaaaactattttaaacaagatttctgtatttctgtttttttttaatcaactgtctgctcaaataagaacattcttttaaataataattttaaaagagattttcagtactcgaactgagtatgcttcagattttatagcatattgtatactctaaatttgttaatagttttaatgattaatgctttacacaaagaaatagtaaagattaatagtaaagtattcattaattcaaaccaatgactgtaataagatagcactaaatgattatttaaaataactccaagacaatcccataaatgttggcaggaagaaattggaaagagaaaaatacaacctttttttccccttcaaattgaaatacagatttcacatgcactaaaattttcttcaaagttcatattgcatgattaatctttcaagaagactgtaagaattttataacattatatgctaatacctctccccctaatcaaaacatcaaaaaacatatactataagaaataaaaagaaaaacaaacaaagcaaaacaagcaaggaagctgctcaaacaaaaggaacacttaacttctatcttggtgtagtaagattagaggcaatttcacttatttcccaactggagtctgatttttttttcattctttgcactcctatacatagtagtaatgaaggggtgcatatgtgtggataatcagagataaaggagaaagggaagattgacgattttagaggctttttaaaaagtgtgattttgtgtttatttattctagttagtggctactaacctctgctcctttaatttaatcctttgagcctggcacatgaaaatattttctagagatatatgttactaatacctcagtgctcagtatttcaaaatagtaaacacagaggatgaacttacagaaataacctgttttttcttatttttttattataatggcaactgaaatgtcataagaattaatatttatctccattttattttgatatgtttgttaatgtttaaaaataatctttgcatgaataagaacattgagacttcaagttaaagtgaaatcaccctcatgtatcccccatgcaactgcctttcacaaagctgagactgaaatcaactgctattgattttcaccacaaagttgaattaaagtgaagccagccttcaataacaggtagggattcaccattgtatttccacaaatacctatacttcataatgttcaatatgagaaggcaaaggcacatagagtttttaaaaatttggttacacacttgcagacacagggtttactcagttcatagcctctgcagattactggaaattaaatctaatctgagatgtggtggaaactgctagtttacagtagttttttggagagtgtgtgtggtctttgctagttcttggtgactgggagaccaaaccagtgttggccttggggcaagactagggaatagggaaggatgaggatgaggaacagacagaagagggaagggtggaggggcgactcatttaccatttctctgccagaatagtgactgacagagagaaggaaggccaaaaagtgcactttacagatgacataaattttgttcaaaagtcatttgagaaagtttgctggtacttaaacgtttctagctaagtttgccctacttggaagggcattttcacctgtccctcattcaccttcttcagtccctctagatatccttaataaggctcaatgatttagagcttgagtgttggaggccacggaagcagaaacttgttcagccactcgagggctacaaatgggttagtgtcctcctttcagcaaaaattcttagtctctttacttttatagaccccgttacgttactatttcctttgtaatcttatcccaccgcccagttcttttctttcccttctccctctttcctctctgtctgtcctctcctcacctgtccaccgcaatggccgtcatggagtagatgctggcgaacacagctgtgataggaaagaagttctggaagcggcagtagttggcgccaaagtaccactcgctatgaagcgcgtagatgaaattgaccaacgtgttgaaggcggccatggaggcgtcggagaaagccaggttcacaaggaagtagttggtgacagtcctcatgcgcttgtgggccaggatgatccagatgacgatgagatttcccaaaactgccactgccaccaccacaccatacgccagggaccagagcgcgatgcgccaggacggctgcacgaactggttggtgaggttggcccagggctgggagggcgcgggggaagccacaggcagtcccagcgcggaaggggaggaggagaggttgccagcttggtccagcagttgcagccacccagtctcaactgcccccgtggccgccccggcagctagcgaggcggtcaggttcacggcgtctgcacccacgcctccacccccgtctatccaggtttctgctgctgggagagtggccatcgccaccggtctgcagtcccggaccctcccactcacccacgggcagcccaagacgagactcctctgaagttcttctctgcctcctggtcactttggtgccggagtcttcagataagactggaagctgaaagatactgcaat

SEQ ID NO: 2106 - DNA, 83836 bp, Homo sapiens
acatggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaactagaagacagatatattgttagataactgttgccatcttgtggcaaaccacaaaacagtcacttagaggcataccttggagacagtgtgggtttggttccagaccagtgtgataaagcaaacatctcaataaagcaagttacatgaattcccaggtttcccagtgcatataatagatatatttgcattatactgtagactattaagtgtgcaatagcataatatctaaaaaggcaatgtatataccataatttaaaaaaatactttattgctaaaaaatgctaccaatcattcgagctttgggtgagttgtaatctttttgctggtggagtcttgattccatcttgatggctgctgactgattagagtagtggttgctaaagatgggagtggctgtggaaatttcttaaaataagacaacaatgacatttgcaacatcaatttatttctttcatgaaagatttctctgtagtgtgcaatgctgtttgacagcattttacccacagtagaaattatttccaaagtggaggcaatcctctcaaactctgtccctgctttatgaactatgtttatagaatattctaaatcctttgttgtcatttcagcaatgttcaccaggaatagattctgtctcaagaaatcactgtttgttcctccgtaagaagcaacccctcattcattctagtttaatcacgagattgcagcaattcagtcccatcttcagtctccacttctcattctagttatcttgccatttccactacctctgcagttacttccttccctgaagtcttgaacacctcaaagtcatccatgagggttgaaatcagcttctttccaatttcaattaatgtggatattttgactccttccataaatcacaaatgttcttcatatcatctagaaggataagtcctttctagaaagttttcaacttactttgcccagatgcatcagaggaatcactatctacagcaactagagacttacaaattattcttaaatgatatgatttgtaagtcaaaactactccatggactgatccatggactgcggaatgtatgttgtgttagcaagcacaaaaactttcatctccttgtacatctccataagagctcttaggtgatttgatgcactgtcaatgagcagtaatgtttgaaaggaatttcttttatttttctgagcagtgggtcctaacagtgggtttaaaatactcactaaaccatgctgtaaacagatgtgttatcatccaggctgtgttgttctatttctagagcacagagtggattcaacataattcctaagggccctaggatttggggaatggtaaatgatcactgacctcaacttaaagttaccagctgcattagtccctagtaagacagtcagcctatcctttgaagatttgaaaccaggcattgacttctctctagtatggaaagtcctggatggcatgttcttctaacagaaggctgtttcagctacacttaaaatctattagtttagtgtagtcaccttcatcagtgatcttagttagatcttctggataactttctgcagcttcccatcagcacttgctgcttcacctgacacttttatgtcatacagatggcttctttccttaaacctaatgaatacacctctgctaatgtccagtttttcttctgcagcttctttacttctgtaagccatcatagaattgaagagagttattccttgctctgaaataggctgttgcttaacggaatgttgtagctggtttgatctttctatccataccacgtaaattttattcatgtcagcaataaggctgttttgctttcttattatttgtgtgttcattggagtagcccttttaatttccttcatcaatcctttctttgcagtcacaactgggctatctggcaaacaaagtctagcttttggcctgccttgggtttcaacatgccctcctcactaagcctaatcatttcaggcctttgatttaatatgatagatgtgcagctcttcctttcacttgaacacttagaggccactgtaggattattaattggtgtaatttcaacattgttgggtgtcaaggaatagggaggcccaaggagagggagatggaaggatggctgatcaggggtgcagggagaaaacacacacaacatttgtcaattaagttcaccattttatacgaatgtggttcatggcgtcccaaaacataatagtaacatcatagatcactgatcacaaatcactataacagatattataataataatgaaaaggtttgaaatcgtttaaaaattaacaaaatgtgacagagacaggaaataagcccatgctattcaaaaaatggcactgacagatttgcttgaggcagggttgccaaaaactttcaatgtgcaaaaaacctagcatttacaaagtgcatcaaagcaatgtgcaataaaacaaggtgctcctgtaatagaatgctgggaggggtggtatgatcatttactttggatgtttaaaggttttagtactgatagcttaataggaatatctagttctttcaggcatcaacaagagtaaaagtactgaagtagtatttttctccaactgaatcaatcagtgggatggaatttacctcattttatgttctctttctccttttccattacctgctctctatgcttcacccaacccattctttcatgacctcaagtttacccagcaaaatcttcacatctaccatcacctgtaccagaacttgtatttctctaatttttcagtggactaaatccttcacgttttaccttatatcttgctaaaacacttttgctagctaatcctagtttattctagattcctttattatcatctctcatcatatattctactttctctcttatttcatagcattttttattatttgtaattatttagtcatctgtgtgattttttgttgtttaatttaaggatcccctctttctagaggaaaagccccatgaatggaaaagccccttgaactgtgcctattttgctcactccaggatgagtattatttcttagtattatttctttaaactgaacaactctagtaagattccattcttatatcagaaagtaaaatgactataagatagcatgagacattaattttgtgacaaaagttataaatgtagcattggttctaagagatgaaatccttgctcttctgagggtctgcagagaacaacgaacagagctagacaaatataatttggaggtaagaatgcaaataaaaaactcaaattattaaattatgtatgtaatacatccagttccaaatgcaaaagaaatagtccttgattttcatacactaccatattatcattttatagaaagatttccatgatttattttaaaatgcacaggatattctctctcttacacacacacatgcacactcttttttttttagatggagtctcgttctgtcgtcaggctggagtacagtggcacaatctcggctcacagcaacctctgcctcccgggttcaagcaattctcctgcctcagactcccgagtagctgggattacaggcgcccgccaccacgcccggctaatttttgtagtttcagtagagacagggtttcaccatgttggccaggatggtctagatctcttgaccttgtgatccgcccgcctcggcctcccaaagtgctgggattacaggcatgagccaccgcacccggccatgcacgctcttttgagcacaaacacacacatacacacagatacaaagacacagacattgaacagatataaatatatactatgtcaaataactattgtcaaaattttaccaattttagtgtaccagttttagtttaacccaaaaagctgtcactgtttagaactttgaaataacaaaatgctatttactctaataagttattcctcttccaaatgtggcatagacacaaaagagggagaaaaaggagaaaaagtcctatagggacatactataacataagacaagatgtaccaaccacaaggggaatagagatagaggaaaatatctctatttcagcaaaaacaaatcatttcaccttcaaacaatacgattatgttttaaagaaccagtgaggatcagtttcaaattactattagtgtaaactactcaagtagaatgatctgttgaaatgggattgttctgaattacaacagaaaggccttccacactgcggaaagcagaaggccacccttagttaacttataatccagatactcatttccaaattttaaattaaaagaaaatacaaattttaagcttcttaccatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctagaagaagaagaagaaaatatcaagtgaatagttttttttttatttctggatgatatcaaagataatcatcaatgtccaacaaggtcttcattttagtgcatcagaaggattttaagagcatgtcacctgaaaagtctcattccactgaaatcaagaagtaagcagacttttacaatatgaacagagctccttacctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctagcagaaaatcaattaaaatgataaccaacatttcttgaaagtctcagaaatacagacaagttggagatgggttgtgcttgagaaaaacaaattgttccaacagaaagtcttttagagtaactaggaaaccctaataatatataacagagcaaagaaaacttatggttgagagaaaggaaattcatcaactgacacacctcgaataagccactaacagatattttcctttactttccctttaaaacaattcttttgacttgtataaacttcttcctactgcctttctaaaatgtagcagatattaacctaagaaatttatttatacacaagatttaaaatgaaggaagttattcaaagactaaacttaaagtcttttttatgttacaatttaaatgtgaaatccacaactagagcatgatgaatgacatcagcaacatttgttctaacccctcctatgccaccatgtgacagggagcaagttatcacagagttccttcaactgtgaaatgaagacattgtactaaatgattcatttatttatcaacaacttattgagtttccattctgttccaggtaccctgtggagggtttaggctgtaacaatatggtctctaccagctccaaagcttaattattttcttaacaaattgcatgaagtgtaaatggaacaggctagcctttacactaacacttcctttcatgtagaaacaattaaaaaatagaaaatcctgtgatggactctttgtaggaatttagatttccagaaaatttacaaaattgtacaaaatcaaatgacaaatgccaactaaaacactttccagaagttgtagaaaaagataaaatgcaaattcatttttaagtacaaaagcactttgcaattaactggagaacattttattcctaattctcctcctctcacctctacctaagcagctaatcattacatttattgaacttctgaaatttgtaaaacactctgttgaatgctataggaaatacacagaaatggaaaacacagcttctgtcttcaagaagtgtatttacattggagaaacaagtcataatatatatggatacattaaaaaaaaaacatgcaatatatatccaacagagaggggcttacttcagagcaaccatctaagaggttttacagttactccaatatcacttcaccactccaaacactttggggaccaacactttcagaatcagccttagatcctgcaatacatctctttactatttcgttagtggcaaatctgcacctttggatttttgtttgtttgtaggcacagataaaagcatttggagcaaatatttttttaattaatatgaaatgaatgggaaactgttagtaataggattcatcatcattgtcatcaccaatgtggtcgtagtagaaatagtaacagcaaaggcacatagcatttataatgtgctaggcactgttctaagcacttcaaataccgaattcatttggaacaattctatgaggaaagtacaactgttaccatcattttatagttgaggaaattaaagcacaaaaaggttggtaaacttacccagagatacaaaaaaagagtgaatgggcatttttggcaacagtgctttactactacacacatatcggggatgggaattcttctctgtaataggatctgaaggtaattcgcaaggagacttccccacctctcagaaaactcttctgaacgcttgatgcaacattgagtaagtatcaaatcttttttattttaagaaacaaagcttatccgcataaaaaattctatcttttcttaaaatgtgggctttttattttatagctgtatcttaaacgcacaacacaataaacaatcataatttagcacaggtggatcgggtagtttgcataaaaaatgccccagagcgggaagcaattacagctgaaggagaaacaaaggtggtcatagggaaagccacagaggaagtgacctgggctttgtaaaacttaatgccgtgatatacttaatgagattattttgaattaaagcagttgttttcatcttccaatctaatttgtctaattacatgtttaaaatttccttattgtgatgacttcagaagaagactacaaaaccaagtcttgactacctgatatcactacagagtctgtatacaaacacccttaattttacagaagaaattaaattaatatatcaggaatgattctcatacctctaagtacagatattattgactctatttattatgcctcatgctttggtcccaaatgatactgttgagcaggtaagagttatacatttttaatagttttggaacaaaccaaagtcagcaaaccttcacagaaacttcttttttaattcacctagaattaaatcactgagcagagagaacactaaattcaagttcctgtagttaaattagtgaatatgcctatctctctctttcctttttaaatttttgttttctattgttattgttgttcacttgcttgctttcttgtctgagttttactctaaatatgaggctatttctatcctcagccatgatgaggcaattcagcctagtgaaaagacactaagtctggaatctaaaactgagttcaagcttggctgtgagaagaattaccgtgtaatcttcagcaagacttgtaacacctttcacttagttattaatggggatggaagtcaaagcaatgtgtagtgttatcagaatgggggagaaagaatatcatgcaccaaagttaaaaaaatagagggagactatgttgaatcccaacataaattggagggcaaaaaacaaaatttttttcaaaaaaagtacttagaaattaaaatggagaaaacaaatgggcttattgcagaacagtttaaggaaggaggagaaagttgtagaggatgaggaggcctgggggaatagggagcacaaggaaagggagaagtagcatgaggaggaggaggaggaagacaagtataaggaggatgagaaggaggatgaggaagaggatgaagagaaggatgattaggaggaggacaaggtggagcatgtggagaaggaggaaaaggaaaacagggagaacaaggagaaggaaacgagcaagcatgagtaagaggagcaggaagaggactaaaaggaggagaaagataaggacagacaagaaggacacaaaggaggaggtgaagaatatatggaagagtctcttttaataagtacagaatgtgaatctaattctattccactaaatctcataaaaggccatcacagaggatagcttcagtaataaagtgaacaagaaaatctgattgtcactcagtatccttcatcaaccatccaaatgtttgcttaatggacccacatataaagcacagagtggtgcagagggaggatatatataggttcagcattctcttctcctaccagggggaatctggctttccagcactaaagaagtcccaaacttcaaaagccaaggctgatgctgagcccccaaaaagctatcactgtccaacagggcaagaggaccaggtggctgtatgtggtagcagaatgattccactggattcctcccattataaggggatgctcttggactcacaaagatagacatatacaatatatgtcttccctgccttcagtgcctctgcaagcaccatcattcatggacttatagtgcaactgatatatagccaaggtttcctgtgaaaactatctcctaaccattttttagcaaaggaagtgagacagtgggctcaatacatataattcatggatcacatcacctgcaccctctagtagcaaccagtttgacagaatgatgaaatgtcctgatgaagcctcagccagggtgcaagccaagagataacaccctgagaggttggagttctgttcataggttgggcagccaagtatatggtgtcatctctgctgtagagaatgcacaaatccaggaaccaagaggtgagagtaaaaggggtataagtcaggctcaggggctcctgccagtaatcccagcactatgggatgccaagggggaggactgcttgaggccaggtgttcaagaccaacctgaacaacataactagacctcgtctatacaaaaaatatattactttgggaggccgacacaagcagatcacgaggtcaggagatcgagaccatcctggctaacatggtgaaaccccgtctctactaaaaatactaataaaaaaaattagctgggagtggtggtgggcgcctgtagtcccagctactcaggaggctgaggcaggaggatggtgtgaacccgggagacagagcttgcagtgagccgagatcgcagtgagccgagcctgggtgacagagtgagactccatctcagaaaaaaaaaagaaagaaagaaaaaattacccaggtatggtgtcatgagcttatgttcccagctactcgaaaggctgaaggagagttacagtgagctatgattgcgccactgcactccagctgggcgacagagttagaccttgtctctaaataaataaacagataaataaagtaatctatcttatttttatgcctaatacaccacttaaagaattcttactgacaggccagatggccaagtaggaacagctctggtctgtagctcctagccagaccaacgcagaaggtaggtgatttctgtatttccaactgaggtacccagttcatctattcaggatggttagacagtgggtgcagccctctgagggcaagcagaagcagggtgaggacccaggaagtgcaaggagccggggacctccctcctggagccaaaggaggccatgaggagccatgccatgagggacagtgctctccagcccagatactatgcttttcccaaggtctttgcaacctacagaccaggagattccctagggtgcctacacctcaagggccctgggtttcaaccacaaaactgggtggttgtttgggcagacaccaagcgagctacaggagtttttttccataccccagtggtgcctggaacaccagcaagacagaatcattcactcccctggaaagggggctgaagccagggagccaagtggtcttgctcagcgggtcccacctccatggagcctggaaagctaagacccactggcttgaaattctcgctgccagcacagcagtctgaagtcaacctggggcactcgagcttggtgtggggaggggcatctgccattactgaggcttgagtaggcagttttcccttcataatgtaaacaaagcctccaggaagttcaaactgagcggagcccaccacagctcggcaaagccactgtagccagactgcctctctagattcctcctctctgggcaaggcatctctggcagaaaggcagccgccccagtgagaagcttatagataaaactcccatctccctgggtcagtgcacccacgggaaggggtagctgtgggcgcagcttccgccgacttaaacgttactgcctgccagctctgaaaagagcagcagatctcccagcatagtgctcgagctctgctaagggacagactgcctcctcaagtgggtccctgacccctgtgcctcctgactgggagacacctcccagcagggctcaacagacacttcatacagaagggctccaactggcatctgatgggtgcccatctgggacgaagcttccagaggaaggagcagacagcaatctttgctgttctacagccaatgctggtgatacccaggcaaacaggggatggagtggacccccagcaaactccagaagacctgcagaagaggggtctgactgttagaaggaaaaccaacaaacagaaagcaatagcatcaacatcaacaaaaagaacggccactcaaaaactccatctgaaggtcaccaacagcaaagaccaaaggtagataaagtcaccaagatgagggaaaaccagcacaaaaaggctaaaaattccaaaaaccagaatgcttcttctcctccaaaggatcacaactcctcaccagcaagggaacaaaatcagacggagaataagtttgacaaattgacagaagtaggcttcagaaggtgggtaaaaacaaactcctctgagctaaaagagcatgttctaactcaatgtaaggaacctaagaaccttgaaaaaaaagttagaggaattgctaactagaatagtcagtttagagaagaacataaatgatctgataaagtcgaaaaacacagcacaagaacttcgtgaagcatacacaagtatcagtagccaaatctatgaagcagaagaaagtatatcagaaattgaagatcaacttaataaaataaagcatgaagacaagattagagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagcaagataggccaaaattcaaattcaggaaatacagagaacaccactaagatactccttgagaagagcaactccaagacacataatcatcagattcaccaaggttggaatgcaggaaaaaatgttaagtgcagccagagggaaaggtcatgttacctaaaaagggaagcccatcagactaacagcggctctctctacagaaactctacaagccagaagagagtatgggccaatattcaacattcttaaataaaagaattttcaacccagaatttcatattcagccaaactaagcttgataaatgaaggagaaacaaaatcctttacagacaatcaaatgctgagggattttgtcaccaccaggcctgccttacaagagctctgaaggaagcagtaaatatggaaaggaacaaccagtaccagccatggcaaaaacaaagcaaaatgtaaagaccattgacactatgaagaaactgcatcaactaatgggcaaaataaacagctagcatcataatgacaggatcaaattcacacataacaatattaagcttatatgtaaatgggttaaatggcccaattaaaaggcacagactggcaaattggataaagagtcaagaccgatcagtgtgctgtattcaggagacccatctcatgtaagaagacacacataggctcaaaataaagggatggaggaatatttaccaagcaaatggaaagcaaaaaaaacaaaaacaaaaacaaaaacaaaacaaaaaagcaggggttgcaatcctagtctctgataaaacagactttaaaccaacaaagatcaaaaaagacaaaaaagggcattacataatggtaaagggatcaatgcagcaagaagagctaactatactaaatatatatatgcacccaatacaggagcacccagattcataaagcaagttcttagagacctataaagagacttagactcccacacaataatagtgggagaatttaccaccccactttcaatattagagaaatcaatgagacagaaaattaacaaggatattcaggacttgaactcagctctggaccaagctgacctaatagatatctacagaactctccacccccaaatcaacagaatatacattcttctcagcaccacatagcacttattctaaaagagaccacataattggaagtaaaacactcctcagcaaatgcagaagaacggaaatcataacaaacagtctctcagaccatagtgcaatcaaattagaactcaggattaagaaactcactcaaaaccacacaactacatggaaacggaacaaactgctcctgaatgactactgggtaaataacgaaattaaggcagaaagaaataagttctttgaaaccaatgagaacaaagacacaacgtaccagaatctccaggacacagctaaagcagtgtttagagggaaacttatagcattaaatatccacaggagaaagtggaaaagatctaaaattgacaccctaatatcacaattaaaagaactagagaagcaagagcaaacaaattcaaaagccagctgaaggcaagaaataactaagatcagagcagaactgaaggagattgagacatgaaaaacccttcaaaaaatcaatgaatccaggagctggttttttgaaaagattagcaaaataggtagactgctagccagactaataaagaagaaaagagagaagaatcaaatagacacaataaaaaaaatggtaaaggggagatcaccactgatccacaggaatacaaactaccatcagagaatactgtaaacacttctacgcaaataaactagaaaatctacaagaaatggataaattcctggacacatacagcatcccaagactaaaccaggaagaagtcgaaaccctgaaaaggccaataacaagtcctgaaattgaagcagtaattaatagtcttaacaaccaaaaaaagcccaggactagagagattcacagtcgaattctaccagatgtacaaagagaagctggtaccattccttctgaaactattccaaacaatagaaaaagagggactcttccctagctcattttatgaggccagcatcatcctgataccaaaaccaggtagagacaaaacaaaaaaagaaaatttcagcctaatatccctgatgaacatcgacgcaaaaatcctcaataaaatactggtataccaaatccagtagcacattaaaaagcttatccaatatgatcaagtaggcttcatccctgggatgcgaggatggttcaacatatgcaaaccaataaacacaatccgtcacataaacagaaccaatgacaaaaaacacatgattatctcgatagatgcagaaaaggccttcaataaaattcaacaccctttcaagctaaaaacactcaataaactaggtattgatggaacatatctcacaataataagaactatttatgacaaacccacagcccacttcatagtcaatgggcaaaagctggaagcagtccctttgaaaaccagcacaagacaaggatgccctctctcaccactcctattcaacatagtattggaagttctggccagggcaatcaggcaagagaaagaaataaggggtattcaaataggaaaagaggtagtcaaattatctctgtttgcagatgacatgattatatatttagaaaaccccatcatctcagccccaaaactccttaagctgctaagcaacttcagcaaagtctcaagatataaaatcaatgtgctaaaatcacaagcattcctatacaccaataacagacaaacagaaagccaaatcatgagcaaactttcattcacaattgctaccaagagaataaaatacctaggaatacaacttacaagggatgtgaaggacctcttcaaggagaactacaaaccactgctcaacaaaataagagaggacgcaaacaaatgaaaaacattccatgctcatggataaaaagaatcaatatcatgaaaatggccatacagtccaaatttatagattcaatgctatttccaacaagctaccattgactttcttcaaagaattagaaaaaaactactttaaatttcttatagaaccaaaaaagagcctgtatagccaagacaagcctaagcaaaaagaacaaagttggaggcatcacgctacctgacttcaaactatcctacaaggctacagtaaccaagacagcatagtactggtaccaaaacagatatatagaccaatagaatagaacagaggcctcagaaataacaccacacatctacagccatctgatcttcaacaaacctgacaaaaacaagcaatggggaaagaattccctatttaataaatggttttgggaaaactggctagccatatgcagaaaactgaaactggaccccttccttacactttatacaaaaattaactcaagatggattgaagatttaaatgtaagacctaaaaccctagaaaccctagaaggaaacctaggcaataccattcaagacataggtatgggcaaagacttcatgactaaaacacaaaaagcaatggcaacaaaagccaaaattgacaaatgggatctaattaaactaaagagcttctgcacagcaaaagaaactatcatcagagtgaacaggcaacctacagaatgggagaaaatttttgcaatcttatccatctgacaaagggctaatatccagaatctacaaggaacttaaacaaatttagaagaaaaaaacaaacagccccatcaaaaagtgggtgaagaatatgaacagacacttttcaaaagaagacatttatgtggccaacaaacatatgaaaaaaggctcatcatccactgatcattagcgaaatgcaaatcaaaaccacaataagataccatctcatgccagttagaatgtcgatcactaaaatgtcaggaaacaacagatgctggcaaggctgtggagaaataggaacacttttacactgttggtgggagtataaattagttcaaccattgtggaagacagtgtagcaattcctcaaggatctagaaccagaaatgccatttgacccagcaatcctattactgggtatatacccaaaggattataaatcattctactataaagacacatgcacatgtatgtttactgctgcactatttacaatagcaaagacttggaaccaacccaaatgcccatcaatgatagaatggataaagaaaatgtggcatgtatacaccacggaatactatgcagacataaaaaaggatgagttcatgtcctttgcagggacatggatcaagctggaaaccatcattctcattctcagcaaattaacacaggaacagaaaaccaaacaccgcatgttctcactcataagtgagagttgaacaatgagaacttacgggcacagggagggaaacatcacacactggggcctgttagtggggtggggggcaaggggagggatagcattaggagaaataactaatgtagatgacgggttgatggatgcagcaaatcaccatggcacatgtatacctatataacaaacctacacgttctgcacatgtatcccaaaactttaagtataataataaaaaaaaaaagaattcttgcctcctgtccccgaaaccttggacttgatgagtttgatggccctactgtccaaggcagtaattcttataccaggaaacatggtcattttctgattcactggaagtagagactaactcctggcaatttaaatttatttatggccctgaaccaacagagatgagaaagtcactataactagctagggtaatcacacctaatgatcagggggaattgattttctgctacagaatgaagacaaggacagtgcttaaaactcagggaattcagtgggatgcctcttagtactcccttcccgatagtcctggtcaagggaaaatagcaacgatcccccaataaaaacaagactaccaagcactcagatcttaaagaaatgaagatttcaattgccctaactggaaaatgactcatccagtcaaggtgatgtcagacagtaaggtaaatacagaaggtattgtcgatgggggggccctataatgagcagtttaggcctcatgaccagctccagaagtgagctgcagctataattaatgttccttaattgcatcctcttctcccaatattttatatgaagagtgttgctggggaccaatattttagtcaggttgcagtattagtaaaagacatcatgggaatgatatggtagttgatgggattttgtgcataccctgtgttaggaacatgcatttgtcaaccacatggaggacaagattggaggttgatagagagaaaagtggtagagtattcaaggtatctttcatttctccctccagatccgctttccgctcttctttccccataagacctgcaggcactctatcaaaggccctcatgtccaggtgctcagcaggttccagacagtgagctctaacaaaattggagggaaggaggagtggggatcgggatatttattcccttggctccctccttgaaggttaacttaggctggctatgtccacaactaaagatcactgttccacgtacagtagctttctacacaaaactagctcctttcaagttctagagaaccttttttcttcccttttccctttggtcataggttgttgacagctccactgttactagcctcaggttactgccctgtggttcacctacactgtgctcagagttttacaaagtgtctctcccctatttattatttatccttatttgagtaggccatctctctctggaaaggatttgacatatccaaagtctaatgctcattccacaacacaatactatgaactatatatactgttaaataagttttcatgaaaaaagtaacaaaaggattacatagacatgaatatattaaaaagagttaaacgcattctgtaaacataaagttttgataggctttgctttcattactaggttttccagtgataaatgtttgtattttatagctggtgattacttggtccttctccttacctgaaaagtcagctaactaccaaaatgaagcttcacatgagaaaagagaaattatttatcctttaatgcatgtaaccaaatataattcaaatgcacttaccttccagtcattcagtttcaggtaaagctcaaaactatttccaaaactctctttgctaattaaaataaccattaacaagaaaataacaatttctagaaacctcgcaagttgtttcctgtctctccaatcctgtggaatgtgagtaaagttgttttggtctttagtagtttaattaataatcagttattttcagtttgggaccatagcatttttactgccttgaaaagaacaatttaggagaaacctgagaggttttcaagaaatctgctactttgccaatggaatctaaagtaaataatagttaaatatttatggttatcctaatggactatttataccactctaaaaggctgcttactgttgctacagatgaggatggcattaatgcactggtacattcaggacacaggatatcatttcttataaaaagcccataaaatgtacctccccgcctacacaactctcattcttactgcaacatcttaaagggattcaggaggcaccaggaaattgtttaaatttcaatgtaagttggagaaatcagttgctaggatccttaaaagtagtgtttccaaaatataggaatatctacactgatcagcctcaaggctttcagaataattcatatgagaaaacaggggtaggatgggatgccgtggagaaaccaaccccgtgcagcagctgcctgtcatgtcttaacatttgacatgaattacatcaagaactgaaatattcaagatcccactcaatatactccatgtgactcacctgcaaaaaaagagagactgctttctgtggcagagaagatctagaaacacacggtcaaggagcttagggaaagtggtaagaggcaaagaaatagatgagaagagagattagagccagtggtaactgcaaccaccatgacagaacaggcacttaggaccaagtgggggtgataaggaataggcaaggtgccaacagagagacaaatataaagctattctctgcaaggggcaactggcaccctggtttatatttcaatagttcagaaaaacagaggctgtctctactctgtacatggagcgtgagaagtaggagccacacaagataagggtaccaggaccacattccctctgaaagctgtcactgtgccactctaaagatgtgctgacccgtttaagaaaagaagaatcgggcatgaaatatacagaatacaccactggagcacagagcagtagtgataataatatttatagtaataacagagcctcctgccgcattctcactatgctcctggtactgtcctacgcattttacatataccatcgtttaatcttcacaactgccctatatagatattatccccattttacaaatgagggaactgaggtatagaaaggttaggtaaattaaccaaagtcatacctctagaaatgtgcagaaacaggatttgagcctccatgccaaagaagctaagcctgtgatccccaggagatacaggattttattttctgtgttgttggttcctgttcacccagaatgtagtagcactgtaggcactcagtgagtgtttgttgactaaataaatgtgtagtaatattaaaagtacatcttctctcatgacatgttcacaaatcattgtcccatgaagcatgtattccagtctttccaaagagcaaacacatggacatttatgcacaacatggaaaggatgtgcataaaaaaagttcattaatcaattccaaattggttcaccaatataacataaaattcagtgcagagatgcttttgttgtttgtttgccaattcttagctactgagagttgaagaactggattaaaatctcctggcaggacaagatgtttttttcctttttggccgagaatttagcgtttaatgggtgttcaataaatattatttttaattaaatggtgggggggggtgctgaattaagtagagaaatgaaatatcaaaatacatttcagtcaatggatctcagaggcttcctcctctattctagtgatcaaggcagttttttgtttgtttgtttgtttgttttgagacggagtcccactctgtcgtccaggctggaaggcagtgacgcaatcttggctcactgcaatttctgcctccccggttcaagcgattctcttgcctcagcctcccaagtagctgggactacaggtgcgtgccaccatgcctggctaattttttgtatttttagtagagacagggtttcaccgtgttagccgggatggtctcgatctcttgacctcatgatccacctgcctcagcctcccaaagtgctgggattacaggcgtgagccaccacacccagccctcaaggcagaagacttttattggcaaccatcttgcatctaactttgtggacttacatattttttcagaagatggtttggaaagggagggcataaaagtaagaatattagcaatgaaagcagataacctgttaaagatttattgtttgcaagatgcttttctaaatgcctgtgataagtacatcatcctgattacagaggaaataaatgaggacactggaagaagggacttgcccaaaacgacacagctagaaaatgggaaagtcaggatttgtgcccagactatttgactcctaagcctatgcaataagaggtcaagatactgctcaagagaattgagtttttcagatgaggaatttctgaattaagtagcttgttgctataaggtaagaaattattattttattgctgtttgccagtctccatcctggaaggtggagtacctccaggattcaagtacctctggttttgagtagaagacactgaactaatgtgctgaggtgttctgaggattgctaacacttcacacacaattaaaataatacttccaattgttgaggagaaaaaaaacaccatcctagagctttcaaatccactacatataatctactgtttacagattgcaaaaactgattgcaaaagacagttgttttcctgactgacccgttcttagtttataacatttaataaaatgtaattttggagccaatgtcttgtattattaacactgtttaagtgttagaacacaggaatgcttactttgaagaagaatttctatctagaatgttttccaatgtcattttatacaagcatccactgtgcctacctactctgttcatctttctgttcctaaaacccactgaactgtttcctaccatagagatttctcactggctgtttcctcagccataatattattctctcggatattcacatggatggttccttcttacaattctgattttaacttaaatgtgttctccttgaggaagtcatccctgaccacccacactaacatagtgacccagacatcatcatatcacattttaattccctgcaggacattttaaaatttatttttgtattttatgtgtataaatgtatggggtacaactataattttgttacatgtatagattgagtagtggtgatgtcagggtatccatcacccaaataaagtatattgtacccattaagtaatatcttatcatgcaccctcttccctcctgctcacccttctgaatctccattgtctatcattccatattctatgtccacatgtacacattagttagctcctacttataagtgcctgcatggcatttgtaactctatgatgttgggctgtgtgtcccactagaatgaaccagaatggcagagcgcatgaacattttctgtctagtttgtcatggaatttctaaggtgtagagcagagcttggcacttggcaggtgatcactgaatagatgagaagaaaataaatgatgaaatgaatgactgaataccatcttcctacgctttaatatagcatcactgatttaatgtatggaccaggatatcattcagaatataaaatgttgtcacaaaagtagcctgatatatcacagaggcccagtttaagattgccattattgttttaatataaaagttacatgattctgggattttgatcaaagtcacaaacactataaaaattacaaaaaaaatacagactatttttgcaaaagtgatgtttgtccagaaaagaatgtttgagattctactttctaaatggaaataatctctagatttgggtgtttgtttgcaacccaggaaactataatgatggctgatccctcacttattttttccaatatatattttgtaacctggtaatagaggaggatacactagaaagcataagaccagaggccggaatgtcttatggaaccctccaatgtaatctctattggtgtttcctctgctgctaaacgtttctgacttttatccactttcactaagttggtataaaggttcgataaagtcatgttcattaagcactttgatattcctaagtagaaagagattcagtaaaataaagtctgttcttttattttacttttaatgttctgatacctgataacaaataaaaagtaataataccttaatcacttcgaaaaagaattaggctcacacattggtctctctttctacttattaggattcaaaacttctataataatacttctaaataaattgagccaataattagcatggagagcaaagttaaaggcaggagaatgtcaccacttaatttaaataaatgaagagttattaattgaattgagagccttagaatgggactgaaattctctatctaagaagcagacatatagtagaatcaaatttcactacctaatcaatgccctaactctaacccttaatacttttattaagagtcagcacttaaattgttcttcaaatatcttcaattctttttttattcactaagattattagtgaagtattaatagttataaaagtgaaatttgttatctggaaatttacctcagacacaaaactgaatagatatgattgtagagacaaataaatattatagatgagggtgtgtgtgtgtgtgtgtgcatgtgtgtatgtgtgcatgagccagtctgctaattactatataatatagtaatgtcaacctcaaaaagcagtttggcaagaccacacttcatttacaggatgcattagctttggtatctttttgatttagaatccttactttgaatatatagaataaataaaatggaataataaaatgtagagtaaattctgcctctgcaagtgcttcttcaagggagatggatttcatttattacaataaaacaccttatggtttggcaaatctttcatcatgcaatccactgagtaaaagttactcaccaggtcttgattcagtattcccaaactgcagaatgcagcatgcaaagaatagagcacaatataaatatttttaaataagcaaatagcagaagccaaagaaaacaaagtggtctattttagtcatccaacaattatgaaatggacatcctttataaggcaatcttttaaaaagctgatgttaaagactgaccagcaatagaataagtatttaaatattccattgcttcccctggtttgccactgggctttccacacagtagaataagcaattctttctgatgagcagaataatttacttgaacctcatatattattggttcatttttcaagagaaaaatgtattggcattcattattaactttttttatcaatcagcatgcatgacagaacaacacagcaattcttcattacactaatggaggaaaaattaacttgacatcaagcctaattgactaaaacctcactaattcttctaaatagggataagtcctgcttgattagtgaaagcaatttagtatagaacatgtttagatagatgcacttttattgctttccagaacttaacactaacaaactgggctctccagcatcaaaggcgagataacggtagaggttcttcacaaaacctgccacagtgtatggataagactaacacaacatatcaaacacataataacaacttggaatttctctagataattgagaagctttaggtgcaatcttgccaaaaaaattgtttcaaaagaaatttttacagatgctgccaaaatactctatagccaagcccatagcaaaataaaacaaatcataaattatcagctatgacagactggtaatcaaaactaacaaggtttcactatgcgggcaatcctcaactcactacaagttgttttacaaaagttcatttgtaagctaattgttagaaatcataacttattacagcaatattctcattaggaaattagtatcatgtatatggagcaaacatgagcttgggatgcaagaccccagaaggggacctcagcatagttttgctgtttattatctgtgtgaacttgagggagtcactgtacttaactggatcttaatttatgcagctgtaagttgacttaataccaagttcatagtgctattgtaggaatttaatataataatagctaaaaagctaccccagtgccctctactcttacccatagccatttatgttcctttttcaagtatttctctatatcagagagtattggctggcaggtcatagaggagcatcagtgagttcatgaacccctttaaattgtatgcaaaatttggtaggtctgttgcaacaggtaatgggcttcatcaagcggctgtctaagggaatgattaaaaaccattgttctatagccactttcttgaatgtttcaaaattagaaaatgacaaatgtttaaaaacaatgactggaagcactctctgcacttaagttgctgttctgcccaactgtattatcccagtaaagtcttacatatctgtcaagatggatacaagcatgattttctcagaagagcatccttgaccatttcgctttcatcatgttccatcccaatatgcgccactccatttgcatcacgtcccaccccaaaacacaccacgtctctctcaacatagtaacttgcatatgcctctactctagtactcatcacactacacaataactattttttatgtcagtaagttctagttttatatgctcaaaaatttctagtcaaataaatatgaattttttcacaaaaataaatgtatacttagattttatttaaagtagccattttaatcgatgagaagcatacaaatcaggaagtaattttgcttttttaaaagaactctgagtgtaacaaatctaagttcaaatcgttactctgatgttaaacctccctgaaattcagctttcctatctgtacaatcaagataattacacctaaatgaatgttgcatatgaataatatttacaaagtatgggtatatttcttgcacgtgacaggtaccaccagcatcacaccaccaactaccaccattattatttctattagttattcaggagtgacaggtacaggcatacctctttttcctgcacttcactttattgtgcttctcagatattgtgatttttacaaattgaaggtttgttgcaaccctgcattgagcaagtctatcagcaccatttttctatcagcatgtgctcatttcatgcctctgtgccacattttggcaattctcacaatatttcaaactttttcattattattatatctattatggtgatctgtaatcagtgattttgatgttactattgtcattgttttgggacaccatgactgtgcccccataagatggcagacttaaccaattaatgttgtatgtgttctgactgctccggtgaccagccattcccccaatttcctcccttctgtagggcctctctattccctgagacacaagagaattgaaattatgctaactaataatcctaaaatggcctctatgtgatcaggtaaaaggagaattgcatgtctctcacttaaaatcaaaagatagaaatgattaaacttagtgaggaaaacatgtcaaaagccaagatagaccaaatctaggttttgtgtgccaaacagccaagctgtgaatgcaaaggagaacttcttgaaggaaattaaaagtgctactccaatgaacacacaaatgataggaaagcaaagcagcattattgctgacatgagtaaaatttgagtggtttggatagaagatcaaaccacccacaacataccctaaagtaggagcaagcccctcttttcaattctatgaaggctgagagaggtgacaaagctgaagaagaaaggttggaaggtagcagaattggttcattgggtttaagaaaagaagccatctctatgacatagaagtgccaagtgaagtagcaagttctgatggagaagttatccaggagatctaactaaaatcattgatgaaggtggcacactaaacaccaaattttcaatgttggtaaaacagccttctgttggaagaagatgccatccagggctttcatagctaaagagaagaagtcagtgcctggtttcaaagcttcaaaggacaggctgactctcttgtttggggttaatgcagctggtaactttaagttgagaccaatgatcatttaccattccaaaacttctagggcccttaataattgtgctaaatttactctgtctgtgctctagaaatgaaacaacacagcctggatggtaacacatctgtttacagcatggtttactgaatattttcagtccactgttgggacctacagctcagaaaaataaaagaaattcctttcaaaatattactgcttattgacagtgcatctagtcacctaagagctcttacggggatgtacaaggagatgaatgtcgttttcatgcctgccaacataacatccctcctgaagtccatgggtcaaggagtagttttgacttacaagtcatattatttaagaaatacattgtgtaagactgtagctgccatagtagtgattcctataatgaatctcagcaaaggaagttgaaaaccttctagaaaggattcatcaatctagatgccattaagaacatttatgattcatgggaggaggtcaaaatatccacatttacaggagttgggaagaagttgattccaaccttcatggataactttgaggtgttcaagaatccagtaaaggaagtcacggtaggtgtacgggaaatagcaagagaattacaatgagaagttaagcttgaagatggaagtgaattgctgcaatctcatgatcaaacttgaataaatgagcagttgcttctcatgaatgagcaaacaaagtggtttcttgaaacagaatctactgctggtatagatgctgtgaacaacgttgaaatgacaacaaaggatttagaatacttcataaatgtagttgacaaagcagtggtagaggttcagaggatggcatccaatgtggaaagaagttctactgtgggtaaaatgctgtcaaacagcatgttctcgcatgtacagagaaatctttcatgaaagaagcaatcgatgttgcaaacttcattgttttaaaatacttccacagtcactccaaacttcagcaaccaccaccctggtcagcagccgtcaacatcagaggcacggccctccacttacaaaaacattagaacttgctgaaagcttggatgatcagtagcactttttagcaataaggtatttttaaattaagatatcaatgtcattgtttagacataatgacagtgcacacttaatagactatagtgtagtgaaaacatatcttttatattcactgggaaaccagaaatcatgtgacctgctttattgtgatatttactttattgcagtggtctggaaccaaattcatctgattttgacaccgactatggttcagagaatatctgagcagggacagccttccaggaggtaaagaacataatgatgtttctggaacttcatacaaagaagcagactactttcatgtgatcacctggctcccagtgcactccagagtttcaaggcatactgttctccttgtctacaacagtgtgtgattctaactagatgggccaccactctgtatctcacagctgtgtagtacatggttgagtttgtaggtgtgaagaaggtaaacgtcaacaatttggcccctgaaaatgaggacactggctcagggctgaggattctgactttctactcagcaatgtattatcatcgctagtcaacgtgaaccacattaagagagagcctattaaaagcctttcccacttttccccaaccccacagtccttcattactacttcccacctgcctgaaattgagaacatctaactcacaatccacccacaaacactttctccaccttccatcccatcttagaataagaacccttttccttttcattgtgaacagctccacttgtactctattttcattttttctctagaaatgtgctccataagatatccctaccatgacttccattctcttttgaacgttcaacctctccctgtctgcctggcctttcctctctgtcttaaatctaacacaatcccaaatcctgatactccactgaactgctcttctccctcatttttttttcacttcaatgacaaactccttaaaatagtttacttttctagtcttttcctatatctctttaccagatccagcctttcctcttctttcagctacttgcagcaaaataatgttccccagagtagctacatgtaactttagaagcattgaaaatgtatgcattctttgccaaagccttttctaaaccaaggaatgagttattcagcacacacacacacaccacacagcaacacgtcctaaatacactttggacctctcaccttacccacagagtttctgctgtccatggcagatcttcccaatctcctctttcttgaaaattattccaaaatgttctctccctaccccacaccagttctctatcttcagataaacatactatggaagatgatctattattctcattcgtctgagccagggcaatgcaaacaaagacacaccttctcaaagaaggtccaatatactagggtccacaggggttcctgtattcacagctaaaaatataccaccactccattccactctggcccctggtcattttcttctgtttcttctgttttttctttgttatgcccctaaggatgggatggcctagcacatgggactttgtccatcaagctctcttctaatgaacctgacaccaggaaatgtgttctcaggaagaagcaaagcatcaaaattcaatccatcaacagacaaatggacaaagaaaatgtggtatcaacacacaagagaatactatgcagcctttaaaaagaaggaaatcctgtcatttccttctttttaaaggctgcatattttaaaacctgggaggatactaagccaggcacagaaataaatactgcatgatttcattttcacatggaatctaaaaaagttgagctcataaaaacaaagtagaatgtttgataccagaggcctggggactgggaggaggagagatgttggtcaaaagggacagagttatacttagaaaggaaaaataagatttagagctctattacacagcatagtgaccatagttaatgatagcataatgtatagttcaaaactgcttttaaaaaagtagactttacatgctttcacaacaaaacaaatgaaaaataggtgaagtgatgaatatgttaataagtttaatttcatctttctacaatgtgtacatatattaaaacataacattataccctataaatatatgcaattattatttgtcaatttaattaattaacttctaaaaattcaatccaactgcctttatagcctttgctcaaacttgctatttgattttgttctctgcaaactgccatggaggccctgttctcttagtctattctggaagccctcatatatatcactcttggctataaattgctcttacatgaactaatccatctacttttgaatcttcaaaatgatccccattatgtcttcaagaaaccccactgcataaaatgctttcctccttccagttgataagtgcttataaatctggcatatgattcgatgactttgaaccaagtctcctactctttcaacagttgctcaatattccgtcattgaaatagaggactttgtggctttgcatctatacataatgttagatgctgtttctcttacttaatccccatcaccctcacttctcaggagcatgatggtgatgtatggttgtatggtagacacagaaataataagatttagtatttaatgcatacctactcttagtcataactttaaaaatatttcatttaatcctcataataatcctgccttgtagatattattgccagtttacagatgaagaaagtgagttttagaagttgaagaaacccgattagttatcagagtcagatttaaactcaaatctacctgactcaagtacttttgacaaagataagttgcactaatgttcatgttactaattaacacctaatgaacaatgtataattcaaaaatgacacaaattttgtgagaaaatataattattcactcatttaatttttcactctgctttaagcctccctaattctaaaagtagaaaaatcagccaagtacagattacctatatttagctgtaatatagaaaaagaaaaaagttgcaatgaaattcaacactgagaaaaatgtttcttaatctaattaaggctatttaaaagaaaaagaaaactaaagaaagcaacctactgagcttagaagcattcctattaaagttggaaacaagacaaattaccaactatcaccacttctactcaacattgtcctacgagcccttgccaataaaacaagagaaataagagttaaaacaattagaaaacaaattaaaaagggcttctttgctcttcaatatggatgcagaaagtccaaaagaataaacaaacaaaacaatactgggagaattcagcactactgcaggacgcaaaaccagtgtactaaaatcagtgtactcttacatagcagtaataatcaactagaaaacagtaggaaaaaagttatcatttgtgatacctgtggagctacaaagtaattaggaagaaatctaacagaatattttaaaaatatttctaatatagtaaattaccaaaccaaaaaatcttaaatatcataaaaatgtaagctgcagcctagttaatctctaaattcaatgcaatgtcaatgaaaatctccacaatgatattgatatggaaaaacaaagacaacttttagtgaaaaaacaaggtgaggagcagaccttgtctttatagctgactaaaaactataataattatggcagtgtggtggtaggtcagagttttgttttttttttccaaatagacaagtgaaagagactagaaagccaaaatacagatacattaatacatacaaacttgatacacggcaggaataaaatgatctgttcagcaaaagaagcgaggataactgcttatttatacaggaaaaaactggatcctcatatacaaaaataaattaaacttaaaatttttgaaagaaaatatggaaggaaatcttagtgaaaagagaaaccacagatttggagaatacatttataaatcatttaatcaaggaaaattaacatccagaatatatgtaaaactcctacaaatgacagactctttcttagaccaaatttcagttaggctcctctgaggtctcttctcaaccagaccttcgacttctgtgtccatttttgcagaattcagtcatagcaagaatcctgccaagtcagtttagcaagaatcccctcatcctttatatatgatcactcttaatatctgatcaaattcctcattccctctgactcagggaaaaatcaaataattatttttaaaaaattcttcattctccaccatccccaaagtgatatataatcaccctggcctgccttcagcaagaattccattaaattggtttagtaggaatccccctacccttgatgttttctcttaagaatattccatgcattcttcccctctctctgctaattggctataaatgccaacctgtctttactttatttagagttgaacccaatctctctccgctgttgccatagaagcaacccttattgcaacagtcttgaatacactcttccttactgttttaacaagtgtcagaatagttttttctttaacacaaatcattaagaaaaaaaaactcaactaaaaatgtgcaaaacagatgaataggaaacataaaagtaaacttatgaccaaaacgcatatgaaaagatgctcaactgcactataatcagaaagacaaatcagaaaaagataccacttcagacttattaaattggcaataatctttttaagtctgaaatttccaagtattgctaaagacaaagagaaaacaggaattattttttgctgttcatgagaaggtaaacaaacataagaggctggaaagcattttgttgttattcagcaaaattaaatgtgtgcatactccatgacccatttttacacatctatttattagataataatatatatgtatatgatacatattaatatataatataaaactttatatatgtgtttatatgtgtatatatgtaaatatatatattatatatatgtatataaaaaactattcacagagggaaaagaaaaacctaaaagtctacagattatctccagaactcaaaacttcataacattggaattgtgtttgcatggacctgaaagcacattccaaaggattaaaattataaactccacaaaaatgctgactatttaaatgtttatcacacaattaatgagaatgttatcttttcatatggatatcaaagtagtccatgactgacacccataagaaactgactgttctccaaacagagtaaatagtacagatttttgtacctttaaaagcacattcatacctaatcttatttgattatactagctgacctaagagttggcaatatcaacattttgtttgtttgtttaagatagggtctcactgttgcccaggctggtcttcaactcctggactctggtcttcagctcctggactcaagtgatccacctgccttggcctctcaaagtgctggaattacaggcatgagccaacagtgcctggcccaatgtttgttttattttttaatgaactttctgtgtaaatgttgatgccaccagcctccacaagaatggaatatactagctggccaaatgattagctaacataaggaaccagaacagataaccctagatccctcctgacattagctatcaaataaaatgcttttgtcaaatttacataacttggacaagcttttatctggggaaaagcaagtagttcttaatgtagtgttttccttccttggcaagtggctctagctggtatttcaaggctctaacagagaatcggtggtgcaaagcctgataaatcgtcatttgaatagcaaattatattggactttaagattctcttccattaagagagagtaaatgttccaaattctcttaatttatctgacaggtcaaaggcaggcttgtgggcatttatattcagaaggttgtctttattactaaattacctatgagcttttaaagtccagctttactttctagaaaatctactcaaattttaaggtagataagaaaaatgagaaagaatggaattctgtatattttaccttctcattttgttaccctaacctagaaggaacatatacaaatagattcaaacagctatgtggtttattacaagaagtcatctttttaagtgatgatctttacataattaagcatatggatttagaagctattcccaaaggtgcaaaagatgaagtgatgcgacttgatgactatgataaaaactaagaaaagacaaaaatggtaaatggaagagggagggagatgtatatttatcacaagtgtacaatgtattagacacaatgttgcatagttgacccataagaaattatttcactttcacaaaaatcagtaaattaagaatctttgctcctcatttaacagatgagcaaaggctcaaaggtgttaattattttttcccaaatcaaacaacatattttaatcctaagatgcaaacaatggcctgtgtaattccaaagcctatgcttctcttccacatccaactgccttgcaagaaaaggagactcagaagaagcaccaggaaagtattacagcagctaaaatggtgacagagcaaggatggtatcatgttaccaagaccacctcataagtaactcaacagggaggggaggggctccagcgaaaaacctgcctttatatttctagcatttagcccacaataggtactcacttacgtgttaaactataggaatggctcaggaagaaagagtgaatgaggattaggaacatagcttgtggcccacgcctgtagtcctaattactctgaaggcggagtgggagcattgcttgagcccaggtgtctgaggttacaatgaccctgtctcaaaaaaaatgaataatttaatttaattttaaaaagaggaatatcacatgctgcctagaacaaccacttacattattctaaaaatgttcagagaataggtagtgagtttagaaactgtacatgattaagcatgtacggagatgatgaggaaggctggttaacaaatggaaacaataggcagcgtagtgtaaggtaagttaaccaaacagaccaggaaacaggattcctgcacttcaatcctaatgtggtacctgtgtgaccttgggtaagttccttaccttctctgtacatcagtttccaaatctgcaagatggaaataataatcgtacttgcctcacagggttgttactgtgaagattaaacgagttaatatatgtaaagcatttaagaatatgtctaacatatatagtcttatttcagaattagccaatctttagaaaagttggacagttgtgggaaagaaggtttgagaaaacttgggagtagcagattgaggaaaaaaataacaccttgaggtagaaaagatggaacttgtttgtagacacgggaaaaggagagattcaggaaagataaatgaaaacaggccagatgtggtggctcacacctgtaatcccaatactttgggaggctaaggcagtaagatcacttgagacctggagttcaagatcagcctgggcaacatagcaagaccccatttctacacaaaaaaaatttagttagccaggcatggtggcatgtgcctgcagtctcagctacttgggaggctgaggtgggaggatcccttgaggctaaggagtttgagatttcagtgagctctgattaagccctgcactccagcctgggttatggagtgagaccctgtcctaaaacaacaaaacaaaacaaaactggaagaggccacaggaaagatgagaatatttagaggaactggccttaaaaaggagaaaggacaccagttctggcacaaaggggacagtggagagaagatgaggacccagagtagtttttttaagaagtaacagaagtaatgaggtgagacagcagagttcacacattccaaatcatcatctcagtctccttgttaaagtaagaaaataagaaataagaattttgtggagtaataaaaaaaaaactttagaacagtttttcatgaataaaagtatacttcatatcagtgaaagtaggctaaattcagtggattcaggtaccaattttcatgaccttagcaacacatagagtaaagccagataaaatgacctgtccagggcagggatgctctgagatagacccagtgagagagaaattccactaacagcaaagacaacccagaatttctcctcatgattggctatatcatctgcctctagttactgtttttatgtaagtaccagtcaatcaagatcagtggaaatcatttcttatgtcattttattatttgtatagttttctattttaattaattgttattataggggaaattaactaatttctgtttttaaatcttgtgatgttcaagaactatatgatttaaaatagtaaatggtcttttagtgaaatagtgcagaccagatatacatatttatctctagtccatcctgaaatgccctcttgaagctatgtccttataaaggaataaagacataaaactgcaaggacaggaggaaagagagacaacatgacagcattgagatttgtattttggaagatggaaagaggaaggcaagttctgactgacttcacaaagaaagtcaacaagaagcaaagtgatgcaggacccagaacctcaaaaaagttcagggattagaggcaccaagtacttctgaaggcagagggcaaagaccggaactaaacataagagaagtggctgcaagtctatttagggaacaagtagaacctcaagtccttcctcccaagccaatgtggcaaggcagccaccccaaatgatgactggagatctacccctggggaaagtgaactagagagaccctcaattcaaagacacaaagcaaactgaagacagttgggaagtacagtactaaagaaaggggtgttatgtcaaatattcttagtgccccagtccccttctcctcccactccacttcccaagtgatagccagtaatattctacccttcttcccaccgccaggcaagaatggagaaaaacacaccacccaaaagactggtagacaagccccatgcatatatgtacacacagaacttccagtcagttttttttgtatttcatacttaaaaaaaaaaaaagagtgctttccatttttctgtgcaaaatgtgtaatatttcagttatgttatggaagggtggaaagtttggaatctgtgaactctgctgtctcacctcatctgttacttcttgaaaactgctctgggtcctcatctcctctccactgtgccctatgtgccagcacttagaataatgccaagtatatgttaagtactggaaaaatacttgttgaatgaattatgtgtatttaaactctcatggaggcccaaccacctcaaaaatgttagcattctattcatagagtgtcacttcatatcagtcatcaacaaagaaaatctccctaacatctccacactttgcagctaaattctattttattgcacctcaactttacacataaaattcacaataatcaacttctaaaaatcactttatatttaatagtatctattcttaaatgaaagcacaggaaatttcataaaaagagagactgatgacagattgctggaggaacgagctccagggtccctctagtggccttgaagagctgacaccctccccaaagtaccaaacattcctcagcaatcaacatccaacaaacaccaaggctgtgtctgggctggggagccccacccggctgcagagatagtgaaatgactccacacttggctacacaggaacgtcgaagagaaaaacacaaagcatgtcacaaggtgacatgtgacacattacctagtaacaataactgaataactggggaaatagcatcttgtgcacccctctttttcctacatcttcctttttacccctctgtgacccccacttttccccaaaaagcatgcacgtgcccacacgcatgccacatagactgttgtgcctcacacttagtaggcctggagcaaaggtattaaggaactctcaaatcatttcgtctaaatatttaaaagttataatcaagctaactgttaaatgttaatatcttctattatttcactgtgataaatatgcttccatgaaaacaaaataaaaacatatgtgtaaaactatgatttttatatgactaaacacagataaaacaccagagacttctaaatttaaatattattgcttagctgagtattctgtaatgagccagaattgcttggatgaataataaagacattcctaagtcatacagtttaagtattctataacatgtctttgttctttctacatttcagcaagatcaaaaattatgcttttataatctagattttcacataatttacattctattgacagtaatgccaattagaccacctttcttaactcactgtaatttttagagagttccttattattttcaatttggaaaaactttgttgaagcagtgacagccgggattgtcaacaaaattcttaaatccatacttgtaactcaaattgaaccctgagttatattatcatgttcaatccttttaatggggtcacctaggttagattatttttataatataaaatattagaaagtattttaattttattattaaaatcactatcacttatattgtaatacttactctcttaaagcaatatccagacctacttatttcttaaatttcatttcttttgattttttgtgcaatgtaaacaaaactgaaaattgcagtctgttgctcaatttgtttaaatgtctatttatttgagactataccttcaaccaaaatagcgagaaaatagtccccataagaaattaacgtcaaaactattatctcaaggcctggtgcagggctgtcaccctggcacgcaccttctcttctttcttcagctgccttcttattcctggaagtgtatttccagaatcttagttccattattccctctcactagataggtagtttacctaggtttataattccacagttgttttcattcagaatattgaaggaattgtgccactgctctccagcattgatgtggggaagtccactaccattcagcttccaggtcccttgtgtgtgacctgtttgattattctcaaagtctttagcatattttcttccccgatatttgcatgactggttctttctcattatacaattccctactgacaccttgagggaccttttctgaacagtcaatcaaaagaagctcccacacatcactctcacatcaccatgctttagtttcatcaaggtaggttattactatatgatattttcttgttttgctcatttctatattttatgtttccattgaataaactgtaagctcctcaagaatttgcttctgaatttccagtgcctaggacaatgaacaggaactcaataaatgtttattgaataagtaaatgaaagcattactgtcataagtggaataaaaacagccttctgattttatttcaaaattatgtaaaacaggatcatgtcgagggcctcatctttgtcatggtgcttagatttactgcaaacatgtcttctgcccatagctaatcctaaatcaggagccttaaatctttaactaaaatataactttggagaagttaaacttatttgttaattatgatttaaaaaaataatttagcctctcacaaaagctgaaggctttgacagccatcctcctttctaaatataaatatgcctatcagctcattctgatactcaaggcacatttagcagctagtttatcctagtaggttcatcagaaggaactttcctgaaatcaggagaggtcacactgagtttctagtatggtcaaggaggtgatcagccctttaaatattttaaatctcaaactgtatctcttccgtgctttgtgttacaggacttgaggatcccaggggagaacttgttcaaggttggaccaggttcaaagctccttctctgtagaagtgtagccctgcctaaagttatcttgttaacgctggaaagatacaggaaaatcttccatcagagcaagaattcaagttaggctccaaatttcatggcagattatccctctgccatctggtatctaaagaattattaatcaatgtttaaattagcaatatagctgactggcacctcttgaatgacttgtcagagttcaaccacaatctcactataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccagcaaagtatataagaacacaggcttcggtataaggcagccttggtactaatccaagctttgccattaggaactgagcatctttgggtttgctatttaacctctctaagtcatactctcctaattacaacagcacttgccccctaggttattaggaagatcaaatgaagtaattcatctaacgttctaggcatagtccttgagcatttaatgaatgttaattgtaattattattgtaagaaattatatacttgaacatttccagattctttgcaaactcttggctgaaagcatcattcattacactgcaaaaaataatttcctcttagctgagtgctaacacagaactggctcttcaaatacacttgagattttccttaatcaggtggagagaagcatatgaccaatcatgttttctttccagaaggaaactcaggtatttgccataataatctcttccagattgctctattttttttgctttttttccccttaactggctttcctttttattttgtttttagctgttcacttttatatcatgtttaactatatagcttgtggatctgccattcactagctgagtaaacctggaggggttatttaacatctaaagttccactttcttcatctgtcaaatgagaattgttgtagacaccagtgatactatcttttcagcatccctttttgataaccactcctctactccatccacattcccttgataccattaaaggggcccagccctctaagcacttagattagtctagaagtgatcatctaattcaagctgaaccaggaagacacttgccagagattttggatttaggactgaaagagtcaggtcaatttccttctagtagctgaaattataagacaaacctcaggaactgctagtggctatgtatcccacttatggaaaagatagcctacagtgaaagaaaagaatgatactaagagacaggaaagagaaggagggagagtcctaggggttctaatgtttcctaggttcttgtttttcctgtagcttggctgttctattagtcatctagtatctttccagtaagttgtcctttgtgcatatataattttgtttgatttctatcacttgaaaccaatatagttctaatacataagaaataatccctacactgagtagttgttataaaaagtaaatgagatcaaataattaagtgctaagcatattacctggtatatgatacgtgctcaagaaattgtgcctattaatattatttagaagatgtggatataaatataaattataagtcagacaattaataaaaacaattttaataatttgcaaatcttcttgcaatttcaaaatcaatcaaaggattatttgattctggatcttcaaagaattgtaaaataaatgctctgaataaattttgctatataatattgtataaatgcaattgagagactctcatatagtaaataatcttagagaataatgaagtccagaacagtgatccacaatttctttcttaactcacttgtttagagtaaacatatacagggaaggtggaaaaacaatgcagacttacattccagttaccccacatatataggaataagtctgacatacataaatgtacaaaaactgacttagctgcataaacagtcatgtttacacagtataaagaatgcagtataatgaaggaaaaatggaattaacatatacctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctatatgggaacaaaaaccaaagagattataagaagaaaaaagatgattcatacagacaaggaaatagagtttactgctttttatttataagaggaaaattgtatgtctattctatgtgtaaagaagtatttttagatatataaaatttctcttttttacatgtattttcatttattagattctgctgttactgtttgttcgtgttagaacacgtatacactcttattttgatgaatatgaatagaatatgaattatgcacatctgttattcaatattaaattgctgatacttgaaaaaaaacaaaaataacctccaaattttacaacatgaatcaagtatttatcttatacttgtcaatatattgactctttgttctccttaaactcacaagcctaataactggaccattctcataattctaaaaataaaatttctgtctttatttgcctatataaagtagctttagggggtaaaatattggatgttttaaataaagtccatttacctgaccatatgtctttaataacatctttagcattctttcaaaaaagaaaagtaggtaaaatccaccaaacacagcaactgccttctcaacataactgtcgactttgggatcaaatccaaatgcctaagggagaaaaaagggcaattcaagtaaaaccaagaaatttaacttgatttctggaaaataataccagtatgcaattctcaccaatgttctaagtctctcttcacatccaagtaatattggaaacttagctgccaaaaatcacaaaacaaaaactttgaaatttgaatgacaaaactgtatgagatggcacaaaaaccttacaactagaagtctcattaaataaagccaccagagaatcttacagtttcccacctataacacctacagcaatatttgccttgaaagagtaaacttttagcagtaaagcagcagctctgattctcatctttagaatacgatattaggtctagataatgaagataaatgagatattgattacctactgtctctaaaagtaatatattagtccatgatatccagaatcaaacttttaaaacaaatatggcaggccacttggattactgttttcccaagagaaatcctcttatacctacagaactgtgataaatcctaaaaaggtaaataaatcaaggcctaggcccaagaataaaagcaaaaagaagatttaaaattgccaccactctctctctctctttcacacacacacagcaataagaatggaataattctttctttaaaggacaaagaactggagttagagtttgaagttataaagagtcaagatgttcctaacagacaagacacataaacttcaaataaatagaatcagaggagagactaatgggtgaaaagccacaactttacaccattccacacattgtaaatctcccctctgaagcagaatagaagatgtctgggttcttgtcctatgtttgcctctggggagacatcatggccgcatcctcatttgaataacttctttgtgcctgtttatacaatgcaaaatggctatataaatataaatgttccatttacctaacattgaggttatgaaaataaagtgaaataagaaaaggaaaatcattttgctacaaaaaactctatgaaaatttgagagattattacaaagacagattctttatattgttaaacttcaagaaaatagaaaaccttaacatcatcaatgtagagtctttagtccacatacagtattagtttgtttaatttactttgacccataaagcagatgagataataaatacatatattatatcatattaaatgtattatgtatataatactcttttaaatcagaaaatctgtattgtcatcctagctttgttactagctgattgtaaggctataatcaaattatttaaccaccctaaattttaatattttttatctctacaattgaggctgtgaaatagatattatcttaggtcctagatcaaataatgataataaatctataactctaaaaagttatatacccactttcaatgtatagcttgaaaaattaaaggaagctttagttataattttctaaaaattacgagataagggtggtactccctgaaatactattaatattttctctctgtatggggtttgtctctccctgtgtgtgtgcattgtgggtggcagatacagtccatgtatacatatatttctctagttcccctttgtggatcccttctatgaaagtctctttctcctttccttcctcttcaacattgcctctcttttcctttcatttatttcccttcctccatttctcttccttatatgggcacaacacagatttgaaataaattgaatagtgtgcactatagtcaagatagatcaataacacattttatcaaagaaaaaaaataagttgctatttatttattagtcctcaattgatattttttccacagttggaaaaaatgaaaaggtttgtcaaccatgctctcatttactctctagtcacttataactgtagtaaatatatgagggaatttagtggtatatgttaaatacattataaatttacatttgacatttgcagtacagttgacattgcatgctctttagaaaaataaataaataaataaataatgaaacagtgtgtggaaaaattaaatttgccaagtgcaaggcagaataaagttttaaggccttctgaggtgtcccagagctgtctgagcacgtcctagtggctggcctcctagaatattaattttgtctctgatagtgatatccactgcagcttgggacaagcctttacaattgctgtgattcagctttctcttatccaagacactataaactagaccataaaacgctgtaagaattatggaggctaaaaacatacaaagtgctaaaacgttcaaaagaaacaattattcacagaaacaaatagccaacatccttacctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaactgtgggtcagagggaaaagagagtagaaattaatcagagcaaggaaccaaatgatgttttcctgtacattaagcttaaaagtgtctttaaaagcttaagacacatatcttctttaaaagaacaaaatctactcaatgaaaagtatatagaaaactgagaatacaaatatggcatagcaagcattaatagtaatactgtttatgttttaatcagccctaaatcatcattatgggattaatgagttttacagcttgcagggaaattggagaacatctagaacagcgaacagcgacaaacaatctgagatccacaggctccaagccacctagtttcatctatggctcaaggaatagattaaaacagcattttgaaaaaaaagaaaaaacaggggcagtgtgagcctcaggacaaaggtatggggtgatgggtgggagggcagggatggagatgggtcacagtgagctagcttcaaggtgaccatagctgctaacactgagtttgtcacaatcatttgtcttcagactcctgaggacagcatctcctcagagaaggtggcaccagcagcacctcaggtccccagctggagcctcctgggaatcaaagtcagtctgatgcaataagcactcaggaagtgagcacatggggcaggagggagcagctgcattacataacccaccctgtgagacacaaattaggcaaaaatattccatacagaagagatgctggtgacagaaaaaggtggtgcatctttcatctctggagacccagggcctggcacccagtaggcacacaataagtattgcttagaataaaatgaatgaatactatcctaagctctatagctaatggcatgtgtgacctattgcctttgggcctcaatttccctctctctatcttaaaggggctggtgtaaggacaaaatgggaacacaagtgaaacatacccaggacagtcacctatgtgtgggtgcaggctgagatacaacgtggcctcagggctgtgcaacatgtgactttgcctctggccccacacactgtacacaaagtacagtgtgacagaggagaaagctgcctctgcatagccacttctttaaaatatccagaaagcatgtttaaatggtgggccacttttctccatggcactgtcagtggagtacactagtaacacctacagctcagggagcatttgccatgtgccaggccctgtgctaagtgatcaacatatgtcaacttatttgaacctcacaaaaccctgtaagagaaatactactacctccttcatacagttggggaaaccaaagcagatggaattcaagtaacctgccagaatcacgcagatagaaagctggattttgaacctggacagtctggctcccaggcccacattttttagcatatgctttattattcctttagagataatctcatttttcaaaagcccaaaggactcaataaaactgtaaaaatgttttcctgaattatacatactttattaacacgagattgttcactataattattgttagtctagaatttctatgtacaaataaacaaacttagtaaatgttcattcagcctagatgacgtggaccaaaccatggctcctgccaccacacacacacaaacacacacaagtgcaaacacacacacagagtgatacaaagtcacctgtgctaagtaccaaatgaaaaggtcagattataaatggtactatgtaaccccgagaatcatcacagcactgaccatgacgactgcatcttctccagacactttcctatcagttgcaggtcctggccatgccctacaacttcacctaacagcccacttcattcccatttattaccttatcaccttaaacaatactactagtccccacagacattccacttggagagagttctcaattccacaccttttatcgtggtagatctacatggaatttctcttaacacaaacatacttctatccatcactagcctacatgccttcattcattcaacaaatatttataatctcattgggtagacaagatatatacatgttgaaaactaaaattaaaaggcaaagaaattgttaagtgccaatagaagcaaagccacatgcacatgttaaactcatcagcttccctgcaaacacctgttccattacccttgttcactacctacataaataacaggaacagtaggatcaatttcagtttttcactttccaccaattaattccatagacaactggtgatcaaaccctaccagttctgcttcaggcatctctcacctctagcctctccatcctcattgccagtggtcttgaagtcagaccctcatcacctctcactccctcatcttatataacatgacagttatcgatctggtgcccctcctactagctgacatggcctacagacttatactaaatcacaaaagtgatcatctcatgcccccatttgaaatcgcccctcataaactgacccttgcacagcctctccagtgttatttacccccttctcaacatggcctttacccaaacactatgttttcccaaccgagctttacctttacactgtggttctctgtctgaaaacactttcctatcttccttgcctaagaaagtcatacgtggccttccaagccaacacaaagatctcctctatgaagcttccctgctctccaggcagtactccctggctggtcaggattcccattactctttgttcacttaccacttcttgtgtgctacagtaattttatcactgatatatttgcctacatcatataaactgtgtgattctcaatgagaagggctatgttttattcatcctcagtgcctagaaaattgtccacgaaaaagcacacattccttgctgaatgaattgataaattccccatttcaaggtgcagcagaactctgtcaaaaagaaataccaatcgatctgcttatccaactttctaactttctttgcccttgcacatttatcagcacaacttgggggatggtgggagtgtaattcatcacattctaagcacactgcatagcttccccttcttgtattgttagaacatcattcagaaaaaaatgtctggagtttccattcaactgaagcactttccacttaactgaagcaccaaaagtatacattagtatgaatctattccttggacatctccatatatacgtgggactttctcaaacgatctgtttcagagagggaccagtctccttataagtgaaccctgaaagattttaatagatttcaaagaaatacagtcaggatagtttacatttattgactgtccactgtgtaagattcttctaagaactttacctattttaactcatttaattctcacaacaaccctatgagataggtgctgctatttttcccattttaatagtgaggaaatatggttctattatgatacccattttgcagacctgcatacagcccaggcttcaatttttgcctggccccatttaactgtgaaactgtatagaatggtgtttaacagtgtgaactctggagccagaggatttgtgttcaaatcccagctcatcccctcactggcatcataggttggttccttgacttccctaagtttcagttttctcatatttaaaatgcagattaaaatagctcctatttcatagagttattacaagaataaaataaaaccagttaatgctgtccctggaatatagcaagcctttaataaatgttgattacaattatgtttaaaaaattagtaagtagaccatgatataaatgttagttcatttaattcactgttactcagtgaaaagaagaacaaactaagaatcaggagctctcatttcaccttaggtacgacacctacaagaagccacttaacctctctggaacttggacttacatcactagttgtattacagagttggacaatatgatctccaaggatgcttcaattaatattctttattttatctactatatgaattaaatatgattctgcaacttcatcaaaaagtgaggcaatttcagaccattaaattattactaaaatgcaattaatttctctcctagagaatttaacttatcatcagtttactgtactcatcaatatcattttataaagcacatgaaatactttcaaaaataaaatgtgaggcctctgagaaattttactgtctacccactgaaatgtcaacataaatgtattcaaatttttgtatcatttggattgtttttatgttgattttttattgctttggatgagctaaagacttgactcttcattaagtgaaaagttatatgaaaaatccagtgcatttaattattttaaaatgtttttcttagtgagaaaaacaataggataacacaggggccagggaatgtggtgaacctatgaacacatgtataagaacaaagacattcttcttcctctgtgccaggcattgttctaggcacttacgtatattaactcatttgatactcccaacaattctataaaggtactattaaagtaactgacccatagagatattaaataatcatacagctgcactaaaataaaacaatcaagatatcacatcaaaaaggcaatagagtgccaagttaaacatcttagatgagtagtaacaagcactctactagtttccctaaattcccctggaaacatttccatatcttctccccccgatcccactccactccagcctcatttcaattcctaagacaatatgcaccctaagaggcatttctctttttattgggttatctgtctgaatatttggtgatcccataacttagaattgctgacttttccattttatgactttgtagtgttgtccctagaattctacctctcacaccctgcttctgacttcccagttctcaactcctggttcctgaaacagagtaacctagtcaactggggtttaaaaattacttttgaatatgagtaattaacttgcacagagcaactggggttaaaaaattacttttgaatataagtaagtaacctgcacagagtagagtatttgctttttctgaaacctcacttcctgtacctagagttatgcacgttagatgtagttatttaacagacctaactaacaggcctaccacagcacctaggtactgaataatgttcgaagtactttacaaatattaagtcatttaatctttacagcaagcccataagaaaggtactattttagatgaggaagctgaggcaggaaaaggttaaagtcatgttctcaacatagctggaaaattacagagctgggatttgagcccaggtaaactggcttcagagtctgtgcttttactgtgcaatactattagtcaagggtagtatcctaaagcgtttgctgaatttactttttaatgtaaagtgcaaactgtattaaacaggcttgtagaaatataaatatactctagcaaaaatatttgcttgaacaattagcaattcaaaattactaatatttcaaaattgaaattactgttattcacaaaattgcaaattatattgataaatgatacttggtgatttctatgctttgtatatataaatacagaatatcaatgagaacatgggttctgaagccaagacaacctgggctgaatctggctctaccacatgcaagttgtgtaactttgagcaaatgactttaaactccctgtacctttgttttcttggctgtaaaatgggaatagtagtgtctacatcatatagttgcatgaaattaatatatgaatatgtaaagtacttcaaagagtgcctgtcatatagtaagtaccacaaaagaattggctatcatcattgttatttttgtcattgttgttgttatttcttttattcatatagagggagactgaagtgtacatgcacaaaggaatccggaaatgaaaacaggcactttctttgttaagtcttcccttttcttctctatctttactctctttatctatctatactcctgtcagatgagctcactcagaacagcatctttatttttatttttttgagatgaggtctccctctgccacccaggctggagtacagtggggtaatcataggtcactgcagccttgacctcctatgttcaagtgatcctcctgcctcagcctcccaagtagctaggcctacaggtgcatgccaccatgtcagctaattcttttaacttttgttgtgatggggtctcactatgtttcccaggctggtgttgaactcctggcctcaagcaatcctctgccttggcctcccaaagtgctgggattacagggatgagtcaccgtgcctagccccagtgtctttaaatatcatctctagactggcaaatccccagtcttgacctctcctctgaaagcaatctcctctccaaatgtctgtgtgcctttgcctactggacctccctgtctacctgtgtatgtcaatgtctcaaagcaaccacgccaaaaattatattctttatcctcaccactcccttcctctacaataaagggctcttcccagtcttctccatcccgggaaatggtataacgatctctccggtttctctggctcaagacttgactcattgttccctctcccacaatcaatccagggcaaaccatttagcatgatctccaggactcatcccgaatctactgcttctccccacttctacttcccccactttagtccaagtccccatcatcctggcatcagctcctggcaatcgcttcctgaccaatcaccctgcttctactcttgccccattacaatctgttcttcagattgtaggcaggtggaatgcccttttaacagatttgaatgagatcacagcattcccctgtttagaatggtacagtgacttcacactacattcagaataaaacccaatcaatttaccacctcccgcaaggcttcctcacctggtctccatctcccgccaggacatatatccttctaccttccccaccaactcactaggctccagacacataggagcctcttgctgctcctcactcatgccaagctcattgccaagctatgttggctgtgccctcaatcaagaatgctcttcactagagacgaccttgctgtggccctctccttctgctcagatgatacctcatcagagagggcttccttgatctatctaagatgacactcacccactatcaccttctatccctcacctactaatattttattttcttcatagcacctttcactctgaaactatgttgtttatttgcttgtttaaatttgcttgtttaaatcttctccactacactgtaagccctaaaaagacagataattattcttcttgtttaccattgactccttagtgcacagaacaatacttggtatgtcgttcaataaatatttgcttaatgaacaaatgaacgaaactttaaaattccaacataattttcaaacagactccctgaacaattggtttatctcattggtgaaagtgacccttctacacatttaagcatgtgagctgtatattaagcatacatatattttattatggtttaaaatttctttgcatcagatcataccgttaaagtacatattcatggaaataccattatagtcacttaaaatagtctctggtattttctttcacctatgaaaattaaaactaataatttggtccctgaaaatttaatctagaagcatgctagttctcttatctcttcattggtaactgcagataaactgacaagctttaaaataatatggtaagcaaaagataatggaaatgaaatgatcaattataagccaaagaaaatgcaatccaatatgcacagcataaaatatatattgtttaaaatcaagaactggattttataaagtttttaagtgtactaaatgtaattttgattcaacaaagagaagagcataacttatgaagcttaaatgagttataattcttcttattccaaatactttcaaaatataagtattattcgaagaagttctatgtagattaattaaaagcaataaagcagaaaaagaggcatattaacttcatttcacaatggttcatagacttttcaaataaaagagaaaaaatgcttctaatataccttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactgaaatagaataaacaaaaaaaaaatgtgataataatgtgtaaaagcacataagcaaagatgctataaagagacacagactatttcatctagatgcacagcactctttatacaaaagcccaccacagaaattgaaaggcccctaaagttgtaaaacagcccacaccagtttaaacctagaaacaagaaaaatagaaaaaaaaaaatcccttcttaatcaacagctttcctacagcagaaaataaataagaattggtttgggcatatctaaggactttatttaaaataggggtgcaccaacaccattcaaacaaagggttttaaaacaattttttattgtcagtaccccctcttagtttacttttcttcagtttgaatggatattttgtgtgtgtcactggcatggctctctatagcatttcttgtagacaaatacctggctccctacagtttcatgctaagaaattcctctcttctctacactgcaataaatataaatataaaaagttgttttaaaatatgtcttttgcacaaactgtttttcattaaaatatgcattattctcaatgacgttgggtaacttttctatattaagttttgaaaatagtgctgggctgtttagaaattcattaactattaacaaggactagaatctacattaggaaaaaaactgcaaaaataattttttaaaggtataatgttgttctcacattttaactgtaagctcttccatatacagtacttgcattattaagaaaaatataaaataaatgctactgaatgtcataagaattatagtgtgaaaaatatccattcactcaaatggaagagtctgtctttaataaacgtaatttaggcaagttatttgcatgcttcagccaatgcttaaaccccaataagaccttagctatgtactatgatctgaattatgtctccccagattcacatgttgaagccctaatccccagtgtgatggtatttggagatggggcctttgagaggtaattaagtttagatgagttcatgaagttggggccctggtccagtgggattagtgcacttataaaaagagacatcaaagagcctgctcacttgctctttctctgctatatgaggaagcgagaaaatgctctctgtgacccaaggagagagccctcacagacagcaaccattctggcaccttggtctggacttcaagtctccaactatgagaaaataaatttctgttgcttaagccacctaggctttggtattttgttatggcagcctgagctgactaatacactatgaatggtatcaataactcaaagttgatgttaattgtttgaccataagatgctgtaattccctttactacagaaacaatgaaatttaaaatgtcatattttgttacaaggagatcactactgtttataaaggaaaaatgaaaaaacatcaaataatcaaatacaccaagatctatgcagttgtccaacgctaagattacaactaccttacagaaaatgcacatttagatttttttaatgtctaagtatgtacctaaaattgttccttattcaacccactgttttgagtttatgattaatgatagctgcatgccatccatagaagaggatacaccacactcaatgccctgttaacagtcttccctttagctcagaatgatgtataataaactaatggagggagaaaatacctcaagatttaattggggaagggaaagtgtgaacagtttattcatcaccaggaaggcatccagaagcataattgctagattcaaaaagtagacagcccttgtggttcaactggacactgtgtgcttccaggaataaataggtgtgatagcacatgatagcacacacagagagcaccactgtttccctgcaaggaagacttaccctacttggactttaaattcctccaactgtaaaataggaggaaaacgggaagatgcctatagataatctccaaagacttttcagaattagcatgctaaggctccctaatacctgatgactgttaagcagttctttttcagactcaaattgtaacccattcctgaatcaggacgcccacttgctaaggcacagtctgcattttttaatgaagtaaaatacaaaataatagaaactatagaccatatcacacataatagggtaagtgttgcttaaccaaactttagttacacatcatatataacatgaacatgtatactggatcatgatgtaaaatgtatttcttgctgtgaatggcagtcacgagcttgaatgccaccacccttaaggatgtcagaattgccaactgtacatcattaaagacaccctcctacatacaattagaaaaaaagaaacagtgcagtcaaataaatatataattaataccatcagatagcttagctgtgcagcatttgtgttgaaattttagctggacaggtggtcagggatagtcacggtagtcatggagagtggcaactgtccaatcaccacgaagaacacagagatgtagagatgataaaactcaaagctcccctcatgataagagaatgagaacagaatacgaacagtgcagcagaactgaattaatggcaagcctgacttatttaaaatagctatctaccagcaagtggaatgaacacaattttggacagtggcctatttctggcttcaaacaatcttgatatttattatactttgacttaacaaagttgaaccagaaacaaaagaaagcagttgtcttagaaagggtggtgcctcccagagtgggaacaaacaggatgagagtccagcgcctgaagagtgagggcaacaaaaccaaccggttataccatggacaaggaggctcaaacaccctcacaagcacaccctttcacctccaaaacaatgaacaaacaaattacggaaagggtaggatcatcaagtgctactcagaaaactattcaggatgattgtacggaatgctatctgccttaataaaactccatgtgctttcgccagctccttcacatttatgacagctttacttcttttcatgcttgtatctatgacactgctgttctcaagcatgctgccctgatgtttgctgtggccttttaaggtttcagatgtcctcgtgttcagcgcgttgacatttttcataaagactctaagtttgaagttaagctcctattcactggtctcttgccacattagggtgacctcaaatgggccttgtatgtgtgaaacaccaaagtaaggtagcattataggtaggggctaggtatatattacaaaagagaccgcaaagtatgctcaaaaccgtttcagcaaatagttatgtgcattttggcttccgcttctgctcttccttcttcctcaccagtttttatgagtcagaagtttttctgcctctttcctaaacatgtccttatgggaaagtggggggctggttcagagagaggatgaaggaagctcaaggaattagggcaagttccttccttagcattttacacaattgagatctggttataataaatgctgaatctgaaagcttcaatactgacaaagattctctccttgactaaactgcagtcaggctcctctgagcccaggcctcgaccctagcatccatccttacaggacctgcatcacctggtgttagcaagaaaccttctaactcagtttaaagagagttccctcaccctccatgtctgaccaccctggtcctgccttcagcaagaatcctgttaggtctgtttaaccaaaatcccccctacccttaatgtttcctcttagtaattttccattcactgaccccctccccactcctacccctgctcctccttggctgtaaatccctacttgtccatgttgtatttggagttgagccaagttccatactgaggtctcttttccccttgtgatcattaattttgtgtcaatttgactggccactggcttcccaaattaaacattatttctagggcgttaaacattacttctgaggtgtctgcagggtggttccagatgagattagcatttgaatcggtggactccgttaagtagattgccctccccagtgtgagtccaacccattgaaggtctgaacagaacaaaaggcagaggaaggaatttgtcccttttttccttcctcactgcttgaactgggtcatttgatttcagtttcttcaaccctccctctagagtttacaccactggctcctctggttctcgggctttcagacacaggctaaattaaagcattggctttcccaatctgtagcctgcagacagcagatcctgggacttctcagcctccacaatcacatgagccaattcctcataatctctcatatatatatacatatatatatatatatatatatgtatatatatatgtatatatatatgtatatatgtatgagtatatatatatgagaatatatatatgagtatatatatgagaatattatatatgagtatatatatgagaatatatatatgagtatatatatatgagaatgtatatatgagtatatatatatgagaatatatatatgagtatatatatatgagaatatatatatgagtatatatatatgagaatatatatatgagaatatatatatatgagaatatatatatgagagtatatatacatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagaaaaaatatatatatatatatcctgttggttttgtttctctggagaactctaacatacccctattgcaatgtttcctgaatgaaatctgtttttaccacttcgactgctgttaggcactggttttttaacaatatcaagtatagtagccatgtagttatactacagattgcattaactccttcctttattctacaaatatttatcaaaccataaaagtctaggtataatattgatgggagaagtagaaagtggggaaagctggaggatgacaaccaggaaggaaatagtacaaagataaataagtaaaactgccttccatcagcaaacttaaatcactgtggcagaaataaattagatacatgaaggtctataaaaccagagaggaaattataaattcacaaaaaacataataataaagaactatgagagttcacatgagggagaaatgatatgcagaggaaatagtcaaaaacaacattgacgatagaatgctgggagagtagaaagaggatgctgctactgctgttgatagatgcaggaggcagataaaagggagggtcctcggagaatctctacctgcctgagcagtgggagaataggatggagccatgggaatttcccgtgcgtgcaaggggcaggagcctgccctcttcagttcctgtgtttgtgacctggaaccaatctgtgagatgggggcctgttagcaggaactccgctagctttgctgagaggtcgtttttttcttttttccttttcgcccaataaattccattctcctcacccttcaatgtgtctatgtgcctaattttttctggtcgtgtgacaagaacccagtataagctgaactaaggaacaaagttctgcaacactgtgattagggaacctaggaagagaagcccatttggcaggatggtggcaactttggttttagacatttcaagttgcaatgctcctgggaccccaaatgcaaatgattggtgagctttccctgagaaaggtagagaccagagacaaggatgtggcttcttctgcaatgaggtcatagctgagtgggagtagtggagctgatcaggagaatcagcatatagaaagaagaacaaaggcttgagaatgcatacacgatttgtgcaaaagcacgaaaaagagccagtatataagcccgagtgaattaagctcaaaacataagaaacaatccagaccagtcaaatttggtagatgtctgtggtttttgccttcctggaatgatgaaagacatgtaacccttgggtttttgtcccatcatctagtaacagacctccttactgccatgggaactgccttccatgtgattttggtaagcataggagcagtctggatcctataatcacctgtgctactgaaaaactctttctccactagtcctgctgtgagtctggggacatcttaaaccatttctgccgccatgtgaaagaaggctaactaagaagtggagaaagacagattttcaataccatcacaataccctggataagctgtacctaaagctgatgtgcaccctgactcttaagttatgtgggccaatgaattccctttcggcttaagctaattaaagttgattttttttcactcttacaaataaaagagtactgatggatacataaagtaattatttaaaagtcacttttaaaagctagtgaatgaatgctacatcataacctataggaaaacaaaaagataagcctttccactctttaaagcttccacacttcttcctgttctccacacacaggctgttttgtctgcttggttgtcttatcaagtggcacccattaaataatacaatacagtaagaccatctgatcctgtaccattataccaaggccttcacatcacaccagaaatgaaatatcatcccattcaaaagccaccccagaaatggtttcagattttgttttgcaatagattgagattctgtgggaggctgagtagctcacattcccaataaggaaagtgctaggtgtggttgtattctctctgtggaggtaaaggcagggagacacagatttttgtaatgcatttagactcaatgacaatcaactttaaataccattacaaagccccagagggagcaagcagcagaactggggttagaatccaagtctgaaagagctctgtctagcttcttttattttagtcacctctaccctgcgctgccctgccagtgattgctacagctgttgctattcagtaagaactacagctactttctgaaatttgccatgtatgcagctgtgatgaaagccatgaaacccatccttcccccaccccaagtaagtggcgatctcctgttctttaaagagatgcaacaagtaagaggtttaataagaatccacctataatcttcatctgttctgctcttatagaagcccattccacttctccttcattctcattcatttattcattaactgaacaggttgctcacaccttctctgagtcaggtattccagtaggtgttgagaataagacatggttttcatcttcaacaatctcatcattcagcatagaaaggagatacatataaaacagataagcaaataaaaatatgcacaacatatcatgtgattaaaggaatgaggtcagggaaggcttcctagaggaggagatacatgtgctaagtttgttattttgatgcatctgattcttggggaaataagacatgatacacaaaaaaattaatggagagatcagtaacgcaaatgagtatgcaattagttggtgaataaattttataagcaatagttatcataagagttctgggaagcatataaggactacagtaatagcaaaccataatatatgcttaacacgtataacctctttaatcaaccacttaaatagattttaggttaaatttggatgaagaaatcctgtctagaaaggtaaatttctaacggtacaagattaaacaatgtaaaagtgttaaagacagaattcagatatatgtgttctcatgccttttgacttgtaagccagtattctggctgctatgtcttggtccaacactgagaaggattcaatgaaagaatcattgagaccctggcagagaatgcactttgttgcccctaatagtgagttgaaacacacaattaaattaactgttaaaccatatttaggatcccactcagagacagacttcaaaaataaccctacaataagaaattacttaatggacacaatatgtattattcaggtgatggctacactaaaagcccagatttcaccactacccaatatattcatgtaacaaaactgcccttgtacttacatttatacaaataaaaaagtccggccagctgcagtggctcacacctgtaatcccagcactttgggaggccgaggcgggcagatcatgaggtcaagagatcaagaccatcctggccaacatggtgaaaccccgtctatactaaaaatataaaaattacctgagcgtgttggtgcatgcctgtaatcccagctactcggaaggctgaggcaggagaatcgcttgaacccagaaggcggaggctgcagtgagccgagatagtgccactacactccagcctggtgacaaaccaagactccggctcaagaaagaaaaaaaaaaatcctacagttcaaacatcagccaacttttctcaccagagtgagaattttaggtatacttcgctttctgcacttcatttcttttgctttttcataattttgtttagtttgcagctatgaacttaaaccatttttgcagttggctccaaaaatgctgtgaagacaagtgagagattcattcatttatttactcattcatacattcaacacatatttaccgagcactactgcatgccaggtacatagcaatattagtaatcatcttaataaatactaaagtagatatgaattccaggattccagaggtttctttcccattaaataatcattgggatacctaaaagtgttttgaatatggcaactggccaaagatcccaagagagcaattgaaatacatacatttaaaatggtagtttgaatttaacaattgggagaccacttctgacccttgaaacaagtgaaccgtcccattaatttatccttttagggctcactgaacaatggaattggtgacttacatgttccacactcacagcaggaacattcaaagcacgagtgactgaggaaattgcttccagatttgttcttcctgcaataatgaaactgcctcaattacaaggcactcaagtttcacttccaaatctccctgatatatacatacatacttatatatacatatatatatgtatacatatatacacacgctgaatctctctctccaccttctcttgaagttttcccctctttaaagtcctcttcaaagtttactcattattattctatcaagataaaagacagttttctaaggtttaagccaagaacactctataaaaataatctctaggtttaagaggtggccagtcaagtgaccccaactctgtttccccaagattaatttttccatttttcctcaggttttcttacacttcttactgaagtcactctggcactgatgccaccaacacacatgcactctcacatacatgcacactcacactcatatacacacacactcacatgcatacacatacatacacacacacttacgttcactctcaaaactctttttgaagggaagatgaagaacgcttttcctgaatatacaatttaaaggataaagatgccttgttttatgatgcactgctagggataaaaagattattatgaaacaatatatagagaatgctgctataaataaggataaatctgtgctccaaatgttaacagtgtttatctctgagtggtaaaattatgtgtggttttattttttttcctttctgcttctttatatctgccaaagtttttaacaatgtacttgtatttcagtttcttttaagaaaaataaaattaagtcatgttttgtttgtttaaaatctctttttccaggttcccctaaacaaaaggcaggctggaattcttagagattttactaaagaaaaagaaagaatgttgaaagctacaacaatctttttaaaagaggtttacaacattttctgtctttgtcatagtgatggacaagtttcccagccctaccccattccatattcagcttttcgaggtcttgtcttgaaaagagaaggtgttcttttagactcctaaaagtgtggtgtggtgtcagagcacagacacccaatctagatccttcgcttcccacccctgacatgtcttcagggggcagaggccaccctacttcccatcatctgctagggaatcccatgggcattatcccattttgccaagatcaaaagcctttgtttccttgatgtacaccaagggtttcccactcagtccttctgaggataaagtgtggagggcatgctgcttcttcaactcagggctggggagttgccacaagaaatgagtgcaccttggccgggtgcggtggctcacgcctgtaatcccagcactttgggaggccgaggcgggcagatcacaaggtcaggagatcgagaccatcctggctaacacggtgaaaccccgtctctactaaaactacaaaaaattagccaggcctcgtggcgggcgcctgtagtcccagctactcgggaggctgaggtctgagaatggggtgcacccaggaggcagagcttgcagtgagccgagatcgcgccactgcattccagcctgggcgacagagcaagactccgtctcaaaaaaataaaaaataaaattagcatggaatgggtttattgttatgtttaataaattaaatattttcaagttttcttaacattaatttctataatggtaagtattaatagatataaatcacatatattaaggctctttggtattctcaataatttttaagagtacaagggggtcctgagaccaaaatgtttgagaatctagcagataaaaatgacacaccagcagagagagcccttatgtaccacttcactgaggagctaggagcttctaacctaatcgtatccaatacccttctcatcctggttatcctacaactccacaaggttgtttctactgatgcatcacccatcagcatgtccttcttctgcccaaactgcaacccttgcacacacacataccaaaaaaacaaaaacaaaaaccttcaaaattacacatttctggcctggcatggtggctcacacttgtaatcctagcactttgagacaccaaggcaggaggatcacttaagcccaggagttcaaaaccagcttgaatgacaaaaataattaaaaattagctaagcatgatggtgcacaccagtagtcccagttactcagaaggatgagcaggaggatcgcttgagcccaggaggtcaaggctgcagtgagtcatgatcgtgccactgcaatccagcctgggtgacacagtgagaccctgtctcaaaaaaattgtacacatttatgccgagagtctaaagtcctaacacttaagaacctcacttgcctgtctctaatattccttcccccttcagcatgctgtaaaaggatagatgaatactctatcctaaccagttataatcagccttatattgtaacttcactgtgactttgcatctcccatgacccctgcctagaatatgatacatctcctctcaaactacccaactcctgtctgtcctgcaaggcccatttggaatccatcttcactgcctaatattgctatacccatcccttctccagactccagacatccctgttatctatttgtttagcacttaatgtgtgcttccatgtattattatcttctcatgaaatggatattccttcaataagatcataaaaatctacagagaatggacttcttcctttttatatcttcttcaacccctaataagtccttggacacataagacactcaatttataaacaattgctaattttgtagattaaggaaagaaggtgaatgaaaggagatttcaaactagcacactgtgtttgaatataattctgagaaatataaatcaataacctgggaatcatctaccaagacctctgaggaggcaaatattccagccataagtttttcttctcattctatgaaactttcctagaatcagtttaatgtggccctgatgctacaaataaactaatcctgatatcagtgtttctaagttgccgtaaagaatatagtaatgggctacagagaaaatcccaggctaaatgagaagaaaaaaattcctggaaagttcataaactaaaagtaataaaaactttatttccttctatttagatggcccatgggttaaattttaatgtactattcttttaggttttttatgtgtgtaattggacccatggaaatgcatgaatacctattccatttcctcacctctcagtcattcctcaacccattgtggtctggcttctattcccaccacttccttgaaattattctatacaaggtcactggaacctccctattgctaaatacaatgggtgcttctcaggccttatctctctgtttttttttttttaattcattgtcggcaacaaaaaatggaattgctggtttaccttaaattaaattaaatgatgcatctaggttgatgtctagatcatctgcttaaaccagcagaatagagagttcatgtgtccttttagaggatgatgaggagggaaaggaatattaatttagaaggttatgttggtttaaaattaatcatttaaaaatttatcagttaaaaaggttgaagttatttatcaagtatttcattcattcaacaaatatttcttgaatatcgcctaaatgtcagacattatgctagttatgggcatagcggaggctttccaggtaaacccagtcctttgcctcatggaccatacagactattgcagagtccatattaaggcatatataactgcaggggccgggcacggtggctcacgcctgtaatcccagcactttgggagaccaaggtgggaggatcacgaggtcaggagatcgagaccatcctggttaacacggtgaaaccccgtctctactaaaaaaatacaaaaaaattagctgggcttggtggtgggcgcctgtagtcccagctactcgggaggctgaggcaggagaatggtgtgaacccgggaggcggagcttgcagtgagccaagactgcaccactgcactccagcttgggtgacagagagagactgaatctcaaaaaaaaaaaaaaaagacatatataactgtagcatagtctggtaagtgtggaggtaggctccatgaatttggagaagacagaggtattagccaactctgaagtaatgggactgtcaaagccttcctggagaaagcagcactgaaggtgaaatgtgaaggaaaaagtagaaataaggctggagaaatatgggagtgggggcagatgcttctgccgtaaataccaggcaaatagtttagagtttattttcacaataatgggaagtcatgtgaggatagtgacatgctcagatttgcatattaaagattcaagttggctgggcacagtggctcatgcctgtattctcagcactttgggaggccacggcaggcggatcacctgatgtcaagagttcaagaccagcctgaccaatatggtgaaaccctgtctctactaaaaatacaaaaattagctgggcatggtggtgggcgcctgtagtcccagctatttcggaagctgagacaggagaattgcttgaacctggaagatggaggttgcagtgagctgagatagtgccactgcaatccagcctgggggagagagcaagaatctgtctcaaaaaaaaaaaaaaaaaaagattcaagtctgtgaactcagctctggaccaagctgagttaatagacatttacagaactctccaccccaaatcaacagaatatacattcttctcagcaccacatcgcacttattctaaaattgaccacataattggaagtaaaacactcctcagtaaatgcaaaagaatggtaatcataacaaactgtctctcccagctcagtgcaatcaaattagaactcaggattaagatactcactcaaaaccacacaactacatggaaactgaacaacctgctcctgactgattactgggtaataacgaaattaacgcagaaataagtaatttctttaagaacaaagacacaacataccagaatctctgggacacagctaaagcagtgtttagaaggaaatttatagcattaagtatccacaggagaaagcgaaaaagatctaaaatcaacaccataacatcacaattaaaagaactagagaagcaagagcaaacaaattcaaaagctggcagaagacaagaaataactaagatcagagcagaactgaaggagacagaggcacaaaaaaacccttcaaaaaatctctgaatccaggagctggtttttttgaaaagattaacaaaatagatagattgttagctagacaaataaagaagaaaagagagaagaatcaaaaggacatattaaaaatgataaaggggaaattaccacttatcccacagaaattcaaactaccatcagagaatactataaacacctcaacgcaaataaacttgaaaataaagaagaaataggtaaattcctggacacatacaccctcccaggactaaaccaggaagaagtttaatccctgaatagaccaataacaagttctgaaatggaggcagtaattaatagcctaccaatcaaaaaaagtccaggactggatggattcacagctctgtatcggtattcacggatacagaggagctggtaccattccttctgatactatcccaaacagtagaaaaagagagactcttccctaactcattttacgaggtcagcatcatcctgataccaaaacctggcaaagacataacagaaaaagaaaatttcaggtcaatatccctgatgaacatggatgcaaaactcctcaataaaatactggcaaaccaattccagcagcacatcaaaaagcttatccattatgatcaagtcagtttcatccctggaatgcagtgctggttcaacatatgcaaatcaataaacgtaatccatcacataaacagaaccaatgacaaaaaccacatgattatctcaatagatgcagaaaaggcttttgataagattcaacaccacttcatgctaaaaacgctcaataaactacgtattgatgggatgtatctcaaaataataagagctgcttatgacaagcccacagccaatatcatactgaatgggcaaaagctggaagcagtccctttgaaaaccagcacaagacaaggatgccctctattaccactcctattcaacatagtactggaagttctggccagggcaatcaggcaagagaaagaaatgaagggtattcaaacaggaaaagaagcagtcaaattgtctcgtttgcagatgacatgattgtatatttagaaaaccccatcgtctcagcccaaaatctccttaggctgataagcaactcagcagtctcaggatacagaattgatgtgctaaaatcacaagcattcctatacaccaataacagatgagagccaaatcgtgagtgaactcccattcacaattgctacaaagagaataaaatacctaggaatacagcttaaaagggatgtgaaggacctcttctaggagaactacaaaccactgctcaacaaaataagagaggacacaaacaaatgaaaaacattccatgttcatggataggaagaatcaatatcatgaaaacggccatactgcccaacgtaatttatagattcaatgctatccccatcaagctgccatttactttcttcacagaattggaaaaaactactttaaatttcatatggaaccaaacaagagcccataaagccaagacaaacctaaggaaaaagaacaaagctggaggcatcacgctacctgacttcaaactatagtacaaggctacagtaacaaaaacagcatagtactggtaccacaacagatatatagaccaatggaacagaacagaggcctcagaaataacgccagacatctacaaccatctgatctttgacaaacctcacaaaaacaagcaatggggaaagaatttcctatttaataaatggtgttgggaaaactgactagccctatgtagaaaactgaaactggatcccttccttacaccttatacaaaaattaactgaaaataaattgaagatttgaacataagacctaaaaccataaaaaccctagaagaaaacctaggcaataccattcaggacatagacatgggcaaagacttcatgactaaaacaccaaaagcaatggcaacaaaagccaaaattgacaaatgggatctaattaaactaaagagcttctgcacagcaaaagaagctatcatcaaagtgaacaggcaacctacagaatgggtgaaaatttcgtaatctatccatctgacaaagggctaatatccagaatctataaggaactgaaacaaatttacaagaacaaaaacaaacaaccccaccaaaaactgggcaaaggataagaacacttttcaaaagaagacatttatttggccaagaaacatatgaaaaaaagctcatcatccactgattgttagagaaatgcaaatcaaaaccacactgatataccatctcatgccagttagaatggcgatcagtaaaaggtcagggaacaacagatgctggagaggatgtggagaaatgggaaagcttttacactgttggtgggagtataaattagttcaaccattgggaaagacagtgtggcaattcctcaaggatctagaaccagaaataccaattgatggtttgcagtcccattactgggtatatacccaaaggattataaatcactctactttaaagacacatgaacacatatgtttattgcagcactttcacagtagcaaagacttggaaccaacccaaatgcccatcaatgatggattgtataaagaaaatgtggcacatatacaccatggaataccatgcagccataaaaaaaggatgagttcatgtcatttttagagacatggatgaagctggaaaccatcatcctcagcaaactaacacagcaacagaaaaccaaacaccgcatgttctcactcataagtgggaattgaacaatgagaacacatggacacagggaggggaacatcacacactggggtctgtcaggggctgcggggctaggggaggtatagcattaggagaaatacctaatgtagataatggctgatgggtgcagtaaaccaccatgtcacgcgtatacctaagtaacaaacctgcatgttctgcacatgtatcccagaacttgaagtctaataaaataataaaatgtgtatatatatacatatatatgtattcaagactggaagaaatgtagaggaaagagatatgtgaggcaagactggatgcagagggcggcagcagtaacagagtgtatgtgtattgaatacttacagcatgccaggcaaaagacagagtggctagacatattatctgatttcatctctactacaatcccataaggtaggtacaattttccccattacacaaagaggatgttggagcttcaagagattaactaagagatatttataagttattatgacaagacttatgtgcatttgatatgggaaggggaaagaaaaagtgaggagtcaatattaacatccagtttcacagcttagttcagtgagcagatagtaatacctatcactaagatgggcaaaacaggaataccaaaaggttttgatggagaaagagatggagttgatgagttttgtttgagacaggtttagacctgttgagttggggaaaagaaaagagttagacatcaattgtcagctgggtgcgcaaggctgaatctcaagagagaaatctgaagtaagccaactcatgtagaaagcatctacagatagataatcacagccatatgagtccttgaagatatacagaaagagtgtgtgacatcaaaataaaacaggctcgagatggaaacctgaggagcactaatatttaaagaatgagcaaaggaaatcaaaattgaaaagcagcagccagagaagtaagaaaaacatggcacaaacagctgcaagcaaggaaagaatgtgtttcaggtaggatgtaatcaacaccaacaaaattatcagagcggtgaggcctgagaagcacccactgaacctaacaataaggtggttccatgtgacttggtataaatttcagggaagtggtggggacagaaaaaagccagaaccaatggtttgaatagtgactgagaggtgagaaaacagaacaggcattcgcacctttctatggtccagttatacacagtaaatgaaacacaaagatcatggaatattcaggttagtcagagcaccgtggccttgctaatacagcatctgattaaagttagcccaaggaaaaagaactgaggattcaaaattggaatgtctggtctcccagaaaaatctggggactttgtctaacttttaccaaatgacttattcgtatctcagtttctgggggaactgatatgtcccaattttctcacaatattgtttcgagtatcaaatgttaattgtcaggaaataactttgcaaggttaaaaactagtttgtagaggaagtaataatgagttttagggccggccctgattattgcaagtacaactttaacaaggggaagaaaagacattttttccctcttttcactcaaacaagaggggaacatcagcagagaacatatgccagcttcaaataaatgattgtacagttcccagtggcttcaagaaaatggcattagttctaccttgacattcaggcacttggatgacacaagaggcacttggctttttggaaaataagtccttctgtgggatgatactcttcagcatgagaggcaatagtggaaagtgcatcggttatagaatccagtcaccctggaatggaatatgtgctctgccaatatgagtcatctgatttaaagtgagttacttaacctacctaaggttgagtttcctcaagggaataacaagagtgtttactccatgggatcaggaggtttaacagaatggtgtataaagaagaactgagcaggatgcctggaacacaagaagtgctccgtaattgttagtaaatattcttactaggacaggacctgtttcctctgccacagtaaaggccctacccacaacatttacttaaacagcgttcatcccaagactagagacagagccagtgtctagctgttcatgctaatgtgtaggtgaagtaaccgaataatatacttacgttctggggaactctgctcctgaagaaaactgtagagcattatgatttaacattcaaactctattacctggtaccatcatagcatgcatctcttaacataagggactgcatgttttatagaacatatgatgaatatttatataaagcaggaacttttgccaagctcagaatcggtgtactgattttactgttcgctgaagttcgggctaactttctgtttccctgtcgctgaagagatacatctctcacttcttccagttagactaaaataatgctcattctcttatctgttttctatccaacagggttcagctaaatgcagagggtcctggattcttcggcttgcaaaacccatatagaggtccatacagatttagaagtagatctcaatttaaaaccgcaattctatccatttctggaagtattatatggttccccaaacattcacatttcagtggtgatgccaatctggggcaaaaataataaaataaagccaacttctaaatgtagcatcagaagtcctctggaagggaggtaataatttcaatgcacattgaagtactcaaattattttattagtctctactcctaaggtttacattttcaagaatttactaccagtgtttggagaaagggaagtggaggtaaactgtaaaagcctctctgaaggtgagtcaccatggaaaccaagactgaaatcaaaggcactggactgacttatttctcactgatcttttttttcattaattcttgctgtcttttcatggctgtgctttcttcttttagttgacagacgcttgggtgttcagatcatcaatggaagacaattttgttaaggataatgtagctatatcgagtaacatactattatgatgataataactatgcattgagcacataatttgagccaggcccaatgctaagtattttacatacattgtcttttgtattacgtattattggaagcaatataggtaatggaaaaaagtcttatatctttattgagttggcacgtataacatactgaatatataagtgcccgaaatatgttaaatgctcaataaatgttaatattgttcttattttctagtccaaaaaactgtcctatgagtaaggctctttttttctcaatttacggatgtgaaaactaaggattacaaaaagagggtaagtcacttggctgtgatttcccaggtggtaaacaagagaattagaatttcagcgcaagcttgcctgactccagaagccagattgtaaaccattatgctgtattctctaagatagttagaggtctaagaagctcaccaaataaattggttacaattatggtttattttttaattaggttcaaagaactaaagacttagaggcattatcaatgctcacttgatttttttctctagctattcaattagttatttaaagaaaaaaagtcaaggtgttaaatatttggccttggagggcataatgctacatttcaggttcacctttaatctagactcaacagatttttgtttttattctccttaaacttcaggccaggaaaaacaacagagtatctttagaaagagacggaagccaaattaaacaaggctccattctgaatgttttctatgctcccaaatcctatcaacacaaaggtaattcgatgaaaggttcatttctttataaaataaatctcaaggctactgaaacagacaattgggaataatttgagaataaattaattagttttgattacaaacaggaatctactgttatataaagttggaaatgggaaaattctgaaaattacctagttttttagatagcctagagtttagtaacattctttttttaaaataaattgcattgtaaatgaccctaatactagctgtttgcacttagtaatgtgtacatcccttgaggaaacaccacttggaatacaagtaacttgcaaacccattaccagccacattaaattgccttcattagatgttgcttttcttttcctgaggatcactgatccttctcaacttcaggccttattttccatttctatttatattcctatttttctcccccaatccctactaccaccaaaaggaattcacttttctcaaaaaaaaaaaaaaagaatcaaaagtatattaaatttaaagaaaacacctttaaacaattattatggttgaaaagtaataggtttttatgactagaaagcagaaaactaagtccctgcccctcaatatatcccaagataagaataaatcatggaaagcataacagctgcaaatctcccacccagatgagagaacaaccctagggaacatccctagagagaaagatctatcccaattatggaaagttcacctgataactgtgtgagaaagctcaaactgcctcctagcagcactgtcttacctatagttaagagtcagtgattctgttgaagtacttggctcggctcacctactcttccctccttgcttcaactcattccccaacacctatgcacaaaccactttctccagtgttgtgcagttaagaatgcaattgcttcagaggcatcataagggaagatttccattctaaaccgccagaagagacagtggattcattggccgaaaacttctagcataaaagtgagaaatgaactgaaaggtttcatactagacatgcctgaagtctatccatagaagaaagtactattgttgctcaaaatatagtcccttaaaaaaattcattatatatgaaacaataaaagaaaatttcatcctctaaaaaagaattcatgtaattcacatgaaaattcatcacatttggtataagcaagagttcaatcaataaattttttaaaaaccaaaccagataagccaaattgactgagttataacttttccatgaggcatttccaaccccaaaaaatccctcacctttctaaactagtagcagatgttttctagtatccatgtgacaatcatatatggccttgtgatatgttttacaatgtctgctttcgtgattactgcagctttgccttccatagtcacttttcacagtttccatcttatttctttttttttttttttttcgagacggagtcttactttgtcacccaggctggagtgcagtggcgccatctcggctcactgcaagctctgcctcccgggttcacgccattctcctgcctcagcctcctgagtagctgggactacaggcacccaccactactcccggctaattttttgtatttttagtagagatggggtttcaccatgttaaccaggatggtctcgatctcctgaccttgtgatctgcccccctcagcctcccaaagtgctgggattacaggcgttagccaccgcgcccagcctccatcttatttcttaattataaggtctctgaggacaaagacaagtcatcatcatcgtagcctccacagctctagtaccatttccttaatgtgactaagcaatgtaaccagataggcagtcgatgactagtaacttctccctgtagttcaaaatctaaggtcatggttgctctagctagagaaagtatggttttctagattgtaattcaaaaaatgcactatagcatagtgtgtaagactgcctgaggttctaccacttacttcgtgacgttggtccagttacttaacctctctgtgccacatttttcttacacataaaatgaagataataatgggacctttatcatagagttggtatgagtatgaaacatgataatacaaataaattggttaagggagtaatgccacacagtaaaagattaataaatcctagctataattattacattacatataaaagggttcatatgactcctagaatagtgggtaaagatgtgattttgggagttagatatgaaaggaatgaaaagcattttcctaatggatcccaatcacacctggcatcaaggcaaactaagctcttgacatcacagtcaaatgaattacgaatgtccctcattttcccaaagccttgaaatacaatcaacacactgtacacaatcaacttatgtgagagtgatctaatagatcagaatggggccattgtcttggaggattcttaacaagagacctaggtaacctcaccctctgtcctgcccttccagtttctcacctgaacaagcaggttagaaggcattcctagaaggtttacccccaccatttctcagcacataaaggggaaaaaaaaaaaagaacaaatgttctttatctcttctgtccatagtcagtgcttcccagaaacaccctcatctaacccatcattacccccaccccaggaaaaagtgcagtagatgacaacaggcaatgcaaaaaacatgtttgcagtatccacacacatacatacactcctttttgctacataccactagcctggccatccattaatatgagcccggagttattctttctccttctggcatcacagggtcagaagataatgaaggaagagatctagcaatacttaaataaataatgattacaggcaaaatattgaaatagaaaaggcttatctttggggccttttgcatactcttcagccatgcctgctcttcttgaagtctctgaaggcagagcctttatattaccttctgagtttctccaaattcaagtggtccttacatctcatgaaatccactgcagatggctccttagctcccaccttgacccactccaatacattccacactctcatgtcagattaatgttctgaaaacacaggtcttatctcacattggtttttaaacacatttattcctagtgttccattattgaaacactaagcatgtgggagttatttatatcccactgctcaaggtcattgccaaggtctgattgcaaaaattcaaaaaattgcaacctcaggcataaatgggttagttccttaatcaggcatatcactgtttcgtgcattataattatatgtgcatatgtcatgtctcctccaatagactgtaaagtcatgtgaggactcaaattatcaaactcatcttaaaccatcttcacccatctattcaaaaaaattataatgaatacatgttataaaccaggcactacactagtctctagagagaggagtcagaccatgcccttcaacttgttaaaaatcttttggagggtagagagaggcagcaggggttatagccacataagcagaaaactgtaatacatataaaataatttacatgttataatataattgcaatatataatatgttataattgcacaagcaccaagaaatacaggattgcattgaagggacttcgactacactcttgagaagatcaagaaaggcttctcagaagaagtaatgtctaaactgataccagagcataatcaggtatttctagagaaccaggcagtgtaaatggtccattaagattggaactgtgacaaaggatacggtttaagaaacatacagggaccaaatcagaaaaggactttgaagccactctaagtgtttgtagtttatctaaaagtcactgaattgtttaacaggatgaatgatatgatcagatttgtatttttaaataaccattcaaattagagtgcagcagtcatttaaaatgtctgctgaacacaggaatagaagtgacatcagcatggtaaaaaatatttcaggaattcagaaaatagagaaatcagtaaatcagtgctggctgtgataccccagaaaggttttatggtgaagtttaactgggcttaagagagtagattttcacagggcaattcaaggaaaagaagaacatttcagtcaaaggcaggaaaggtccaaggaagataatgagttaagaagtggttgagcaaaagcttatgggaatccatagagcagtgagtagtttagtttagtgggtgctaggtctggagaggtaggttgacacaggaggatcaggccttaaatgctaggctcaagatttagagtttgccagctgagacagttcatggaggctttttgaaagagtgttgctttgagaagactgaatatgaactgaaaaaggttaaaaacagaacttggttaccagtagaaatgtgagaagaaaaaaactatgtgcactacaggagatgggctgcaagatatatatcaaaaaatatatatcagaagaagaaattctgaatggaggcatttccagcagctcagtgtgataatttagaaaataggatcttccttttatcaggctgtttaaccactatctacacataagaacttgaaaatacagtgtttgaaagaggaaatgaggaaaaggaacatttgaagaatgagaaaggaacagctgaacaaacaaaaggcagcactgaggccattcttaaatgtcctagattaataacccaggggtatccagatatttggggcttccctgtgtattctaggaactcccctcaatagatcagacctttatccagaaatgagggccccagagacctatttggctaaaagggctccctcttctttgttgttttggtcactgcttctacctaactcttcgcactgtcagtagctataagaagcaaaactattggctcaattgttctactgtctacagtttgaactctgacctctttgatatcccaaagcaacaagctaatttagtagtccttacttaaggatacgaagaaaaatatttagaaaaccttccaaaattgtctaacaaatctccagagttcattagtctattacctgagaaaagctgacctaataaatatcacagccctcaaccaaaagaacaatgttatttgaaaactaaatcttgtagaagattcaataaattcctggaccttgaaacaaattttatcttcttagcctttttcaaagccaaaaaccagtgtctcacaatagacatgtgcattgtttattccaccctgtgaggaaactgaagttgtattcctcagggtatgtaagcattaatgaccctaaaattttactccagaattgggtggtttcacactggagcatacatgaatgttgtgggctcaagtccatcacttaccagcaaatcaatggattcttttagattggtatttcatttgtcatcatttaaccaatgattattgtcatcattaggactttttagaacatcaggcaaggtaccgtggctcatgcctgtaatcccagcactttgggagaccgaggccggcggatcacctgaggtcgggagtttgagaccagactgaccaacagggagaaacctcatctctactaaaaatacaaattagcccggtgtggtggcacacgcctgtaatcccagctacctggaaggctgaggcaggagaattgcttgaacccagagggggaggttgtggtgaactgagatcgtgccattgcactccagcctgagcaacaagagtaaaactcagtctcaaaaaaaaagcaagaacatcaaagagatgtttgttaggcttattaagtggtaaattttccttggcttccttttctttccaaggtaattatgggcttcttcctgtctctttttgatgcccacagaggccataatgagggcagttaaatatgcaaacatgagaatgagaaaacaggtgtcaagatacatataattttacctattgagacatcctgcctgctaataaacagagaatcgtattactggtacacttaaccaattttcctaaataatttaggcatgttttccaatgtctttgcaaaggtgatgtggggaggtcttttgcccctttaaaattcatcaacacctccagacactgcaagataaggaggtcatgcaagtcaaaacaatgtgtgggctacagatatgcagcttcaagtcaatcctctaaacttctttccaagcacgtgaccatacctacctggaaatactggagtcagctcagttgtttcccctatttgataagaaaagaatgcaactagccagcaaacactttattttcttaaatattagcataatttgtgggcatttccatttttccaacacatcatttctcagatattaccccagataaaataccatgcccagaactggaattatagacaatttactaaagaacatgcataaggggaccacaaaacccttctagatcaaagagagaccacctctgacatgccatggcatcagaaagttctacttttcttaagagccatatactttaattgtggtaagatatttctaacaaaaagatcaatctacgtataatgttattaacatggaatttatttgattacagtttccctaactgtaatctaaagtcatattcattaggaaacgccaaatttccaagagcagagtataatatgcagcatttcccaaacatcttggaccccaaaaacttcttgtaacaaactaacatcgtccaaaaatgacaaacgatatggaaaataccgtattctaccctccaatatcagctgtcagtgggacaggagtaaaggaaaacaagtcaaagcactgagttaactgagttttaaaagacggagagcagttttggaaggatgcagaaactacactttgtctacttaacaattttaagaactacccaatcacagagtatttattatagaaataattaggaataatttgattttatgtttacaaagaggtatgatgtttaactgctcctacgtagtttgaagcttgttcttaaacccaaggtattgccaaatgcctagtagtaccctgtttattactgaaaaaatttttttaatcattttggataaatactagaatcaaatatttgacctgacatatgacaaggaactaacaatataagcctagtctaccaccatctggatgaccaaattagaatcttagtctcaaggccgcccctgtttcagccctgaatgcctcatgtaatgtacacaggagccagaactacattatatctcgttttcaaatagcactggttacgcaccgggcaactgttaaccagggtggcatgtgataatcttccttgctaaccttgtaggaagtgtgcgagccgttatctttctggcaagatttaagtaactcattcctatctaaaaagcatctgttaaagtggcgtcacaccctcaactacttcataaagttttctataaaatgttaaaatcaccagagtcggacctctcagttcatcaggcgtaaaactgcagtttccggctgccaaatcccttaacaacgttaaccttttaatccttcagcctcgtctagtgaaaagcaagtgtcaccagataccgccttctacttgagaaatataacaagattctttctcctgcacttttcccaaataaaaacggctcatatacaaagtgaagtctagggacacccacagtacggagggctgcccggacctggcggccttacctggttgaagtgcagctggccaggctccgggacgcccacgcgggaggcggctcccatctgctccagcaagtgctggagctgcgccgccgacaggctcagattcgcgccgaacacgctcagcacatcctcgctgaaggctagccctggcccctccgccactcctccgaggccggcggccgccagcaacaggagcccggccaccgcgcgacccggggccatcctggcctgggcttccccttgagggcccgcgacgggctgccgcgcagagggacgcgcgcgggcgcactggcgtccttgcccaagggcgggagcgtcagtgctcggcgctgctccgagtcagaggtggcgcgggacgcccctggttctccgacgccttcgaaagaacagcagctcgcgacctgcggggcattgaagtggcagcgtagccgaggggagcgataggcggagtgggccccccggcctcctggagagcctgagataaagaggacaaagggggacagagataaaggccaccagggcaccagccggcaggctccagaaacgctgcgtggcagtagccctcaaacgcccggccgggcatggggccagacgccccggatccgggtttgcaaacgccccaggatttgcgtacatatgctcctcccggatataaagccccaaaccacgccacttcttaggaaaaactaaaaccacactaactgtagaactccacctcctcttcctgtctttctgctttattctctccgccgcaaacttagaagtgagacgtgcagtccccaaggagctgcagaaaagggctcttccggagtcctggggattgcgcgtttaaaggggaccctccctctccccggatcttctctgagcttggcaagttaatcggaagcactcgctggcctctcacctctcctatctgtttgtttgtctgtctctgcgtctttctctctgcgtgtcaacgtaagactcggtctctggatctctctctctttctgtctcccgcccccacaacctctgtatctctgacaggtccgcggtgaaactccgcgatccgctccggc

SEQ ID NO: 2107 - DNA, 94214 bp, Homo sapiens
gaatgtttgtttaaatttatttgtttaattgacaataattgcacatatttatggggtacatagtgatgttatacatataatgtatgtatatgtgatgcatataatgtataggaatcagattaaggttattagcatatccatcatctcaaatagttgtcatttctttgtgttgggaacattcatatgttccttctagctacttgaaactaaataatatattattgttagctatagccatcctactgttatgtcaacaaaagggaaattcctttaatgtcccagccctgagccagtgcaagggcaactcacattagcagctgggatgtccaggaacaggaagtttcagagggccaggttcagacacagtgcccacttcaaagcctgggaaatcaaagatttcccaggcctggtggtctgggcatctctcttttctcttgcagaggtggcaaaactcgacctctgtcctcttagggtcctacctgggcccaagaattaaattgatgtaagacaggttaacgggagaaaagcatacaaatttatttaatacatgttttacaggacataagagcccatatgggaaaagagcccatatagggaaaagaagacccaaggatgcagtgagagtcaatcgcttctatactggttgcacaaaggacagtagttttgaaaaggcagctaaattatgtggggaggtttaaaatagaagaattacttgaacaaggtctatacagaattctctcagttccaatttctcatcattgatagggagaatggtattccttctgtgacagggaggccatctcccatgtgggaatttcatctcctgctgttaagacacagaattaagatcagagtgacctcttcatatctgatgtttttaaaatatctgtaattcaaatagtcaatatgccagagcagcacattttgatggcataattcttaacctcttcactctcttcctcttggagattgcatgtagcctcctaagagtacgaagtttaactctaccataagtaaagtataaaaatggcttcctttcctcactccaagagactccaggcccaaaagataactccagaaagtgaggaactagagcataggccagaacctgcttcttttccatctcccctgcaataatcaaacactctctaaggtacagtcaaagaaagaatgcaaaggatgaaagaatttacagacaggtctgtctgtttgggcttttctcataaaatgtggccatcaaaatgtcataacgggagtcacggccaggcttgacttctaatgatgagaaaagttagataatgcccttctttgtgcttttcacaaaagcagggagatctcttgggagaaaaaggatttatccttctttttcttctttagatatacaaagagacatctggggacagggagtggcccagggaggagttggacatcagaatttagattgcaaaaaggaacactggggagggctgacttggttagtttgctttaattactagcagtcaaagagcaactcacaatggtttgcaccattaggaaaagtgattattacacacaccaaaaaaaatcccaaggaagagggactccagggaagaggcttgtcaattcagtggctaaggatgtcctcatggaccatctttccactttctgctgtgcttcttcagcacatcaccttcatccccatgctatttcctctcaaggtagctgtattagtcggctagaactgcagtaataaagtgccacaactgggtagcttaaataacaaaaatgtattgtctcacagttgtggaggctggaagtccaagattcaggtgtgcacaggattggttccttcttagggctgcgagagagaattcattccatacctctctcccagattctgatgatttgctggcaattgttgacattgtagatgcatcaccacgatctctgccttcatctttacatggtgtagctagtattcaaatttctctttttaataagaataccagtcatactagatcaggaacccactctactccagtatgagctcatcttaacaaattacatttgcaatgactctatttccaaataaggtcacattctgaaatactggggattagaactcaaacatgtcgtttttcggggcgagcggggagggcggcggggaacacaattagaaacaaaacagtagcaaaatggctgctccaggtgtcacacctacaaacaaagtccctagaaagaagaggctgtatcttccttactccttttgagaaacttcacagcacacacagcatcacgtctcaatggtcataactatgtcatatgccaacctctaaccaatcactgttgaaggtgctggtattgcagagatgtggaggtgaaatactccagataatgaaattactaccttgcctgacagacaaagagaaggaacatagtaaagttttaagcatgtgagttaccatgtttccgtaatctttcagtcctctaagttgttagcttttctcctttttcctaatcacatctattagcttttttagaatacatgttcattgaagaaaattggaaagcattaaaaataatatattttgaataattcaaaaatcccaccaagacttcttctaatttcccttctaatttaccggtaagtacgtgtttattgaaaaaaattgagacaatattaacattttacaaagaaccaatttaaaatgattcataatcccatcgagatatcccctactaatgtactagaaaatattttcccatatgtatatgttatatatacatacatacatatataacaaaaagtgtggctatagtgtgcgtaccgctgagtagcctgcctttcttcagttagtattaatttgattgtttgcatttcctttctgcttgtggtaatgttattaatcacaactatctggaacaccttacccccaacacatatttacactctacagttctcttttggtatcattaattgcaaaagagttccagctcaagttaaaccacaggaaaaggctcttggttccagtcatgggaggagagaagaggtctgatcagaaatgaattcgacgttattcattaaacccaagtcaaacagtcaaatgtttcctcctttgtgaagtatttttcactgactcctcctccaacctaaggagaattctcccatttgtgcacaattactattgagctgactgtccatgttctctaacataacactctgatttgtgatatcattggttttccacatgccatgatacccttgagagcagagatgagctctgatctatctttatatctccaggcctagcatcagtagacattgaatatgtgttttattgaacaaatgaattcattcattcattcacagaagaacaagctcagaatttttttccttattctctaccatagttccctacaatggtttatcataatttcaaaaagaggcaaagtttgaacaattaatttttaagtattatttggaagaaagtgaaatataattatttcaacactaacctagatattatgcttacatatcagtgaggcatgtgccttaaaaagccagatgtctgtaaaaatcaaataataacttgacaaccaggtgatggttgctaggaaactgcatttttctgtgaaaacatgatgtatgaagtgtagcctagattcatatcctacattaaacatcttccttggagttatctatgaagtctgattttgcatggcttgtcaaggtatataagttattccctcagttatcctgctcctgctcttaaaaatcatatggttctatacatagaatattatttcaacaccattatttgttctgaactcaaggttgtttaggttatagattgaggccccttttggctccaaaacttttcagtggcatcaaatgttagttaccctctcatagttgtcactgaggaacaaccttcacttttgatgtattaattgtgctaagtgaaaaaaagtaaaatatgtacaatgtttctatgtattccaaagtgaaataaaaataaatagaaattatccatgagttttgaaagatttttgctcaccactactggaacataatagagattttactatactctgcctaggaagttgactcctgacattgatagtgaagttccagaaagtgctgaggaactttgctaaattcaagagctgggaattttgtttgaaataaatatctcaatatttaactgctgtattaattagaaaaattgtattgcaagaaacagaaacccaaatcaaattagttaaagccaaaaaggacatactgagatactagaataacttgggtaacttacaaaattgaaggaactaaagaaaaataactgaaaagtactaaggatgtcaggaactagaaccaaagacaacacaactctctccaatcagtccccatagcttctactgttttctcagcatccatctcattttcccgggtttctccttgtgccaggaacatgaccaccagaagctctggggtcaaatacaagaggcaagagttttggctctccacatccttagaagtttctgtgtaaagattacaattgacccagactgggtgacttgcccagcttgtggcaaatgggtgaggttaagtgcattggttgacaatctccagtaggggttgggagaaaccagtttctaaaaggaagagtgaagcttttacatggacaagggcagaagtcaaggtatgcagaaacaatcaacagaagtgcattactccaaacatatccagcaatgattttaataccactttcaccagttttgtcaccacaaagtgacaggacaacccagctcctaacttatacaatgtcatctttatgactattctaaaatgctttgaactttttcatcttaaaacaccaaaggatcgctatgacagcgcaggtgctttttctcacgtgcatccttctacgaaatgcttagacatgaattctgaggcttacttttcacaaattaaaagattttttcatggaaacacaaaagatacaaaaagtagaaagatccatatgaagcaccttcctccacagtttctaagcttctaaaatcaatgtttcccagttcattaacaagctcgtacataattattagagtaacaccattaaggttagcacatacaatgactcccaaagaaaaaacattgtctatttataagcattgctgtgaatgggtggaacgtctcagcaatacagtcacaagcagcagtcccggtgttctcactcagatattccacgtagcacttcatagtatgctttaagtgagggaatgtgacctatagatacatctacacgagaaggattcccataaggcataaactgttcaataaacaatcataaaaatatattcattcttccctatctagaaatctatgtctttatttaaaaatacgtgatgattcatgcttaaggacgtgttgttggacagttggttacagtcttttatctagtcaaaagattcttatctgccagaaatgtgataagtccacttataactagtctctcaaaacatcctagatatttttctctgtatgcatagttaatcatacaaattaatctaacctaatgccatcttgttaccctaaaatgtttaatgataatggcttatcatctttcatccccataaattttctccttgctttcagtgagcagcaacttcactcccatatacgcacttgttgtgtattccttctcctgccaaattcacacagtcacctcctcttccaggataagacgtttactgctgataatcacagccacaggggaaacaaagaactgccatgctcaaatgagggtaaggtgaggcaggtccattaatttacaaagggactgattacaaacatgcaagtggggtgcagggaaaccacaggtgatgctacatgaacgcagggctgaagacagtagagctgttactacccctaggccaaagggacagagagatagtgggcaccaaaaccaaaggaggggaatctacaggcaggtgctggcccagcaacagttttttagatgaactaggtacggaaattgagaataagcatttataaacttcaacagtaatcccaaagaataattgtgtctaataaaaaatgaggtttatctaataataaaaatggggttggattttctatgtctttttttttttttccaagatggagtcttgctctgttacccatgctagagtgcagtggcattatctcggctcactgcaacctctgcctcccgggttcaattctcctgcctcagcctcctgaataactgggattacaggtgtccgccaccacccccagctaatttatttatttatttttaattgtatttcatttttctagtaatttctttgaattctatctatttacagaagtgccagctattgataaattggaaataaggaaaacaagctgggccttagccacagatattgtaagaagcttttctgtagagaaggccttcttgggcaaaacaggcagcccaaggatacccagtaggaggatagtcaaggaaattgatactctatccttcctctcttcacttcctccagtctcttgtcgaagttctccatttggctatacccactgaggtccatgtgggtcagtctctggaggcaaaaagcaggatacagaagggtggagagtggatccccatcctgtacagttgaaaagtctatgtccccaacattgcaaatgcacgaagtcccatcaccacagagtgatgtcatttagtcacggagtaatgtctccctgtgccacttaccaacttactaacactgaactccaaattcactctaaatacatgctctgtcataatgaacagaattcctttagcacccatcctttacagtgagcatgatattgagctgtctcagtagagggcgctggagggatactgcaacaggaaagggctctcctgctgtttgcagctgctgcaagaggtcagcagtgtgggtgggagggcttttgtcatgctcttccctggctgcatccctgagcatggggttcctttgcaacttctcagctgcagcctggcctagcattaaaaatagaacccattacacaggtttgttgtaagtaagtgttttttgttttttgtttttttttttgagacggagtcttgctttgtcacccaggctggagtgcagtggcgcgatctcggctcactgcaagctccgcctccctgattaacaccattctcctgcctcagcctcccgagtagctgggactacaggtgtgtgtaagtactaatttttaaagggcagatataatcagtatattaacatgcagttctcacaggggtaactaaaaacaacttttaattttattcctcactgtctgcttgggagtgaaggactggctagcccttctcctacccctggatgaaacttggggtggcacaatggctgttctcacacaggactttggagggaatataaaatcctacaattacttcaagacacaaacatagtctcaagtcagttattgaaaatgtccaatccaatgcatcaatcagtaattcaatttgtattcaaaggtaagacttctgggaaggaatccttctcttttatttccttactccccactgttcactaattggcttttggcccttccagggttaagtgctcagatgaaggaaagaaaaggggataaaaaagttcatacttgacagatactgtcaaaatgttgcttaatgctgtctgtctgacagatgcttaagactaacctttcttttatagacacttttgggattcttcagaggggttcctgccaagtgatgtattctagttctccaattgccccacatgacttagtccttggttttccagaagttcactcagtactgaccttcttctattttcaagatagtacccctcttacacaagattttaaattgttccaaaccagaacttacacaccactcggctcacactagaccatgggaatattcgtctaccttttatcccaacaaactctacgactgaaggtcaagctggggtagcaacaactctcctcacttcacctgcaaaagcacttgccagacctcctctgagcctctctacagacaccacccgcagtgtctgtgaggtctgctaatggagcttgccacaaaatacagactgaaacaagttttataaacttcctcagctttttgagagagggaagaatttcccatttgaattcttccaaggagatttccccctgtactcataacttttcatctttatttttctttcctatgacccctaagcaaacatcctgttggtgaccataagcttggcaataaattatccacgtgttgcctcactggggttttactaccagttggtctatactgttgtgggaataacatgcacagtcactgcagaaggaattaagccattgtataaactttaaaacatgcaagcccacccattaaaattgttccttgttattcttaccgtatatatccaaagtaaatgaagttgagatttgatgtcatcagtagcccatttgattatctacaagaatcagataacaaactggtattatgggggagagatataaataggaaatcagtgatgtgctcaaactgtaaatctagccccgccatggcttatttctataccagttgcttagcatggccaacccgaaagtcaacgattttaatagtccctgaatagtattatgatgatctctggttacttagtagggccctacctagcagactgtttctgctttaccacatttggatgtcagatccaacttttcttgcactgactggctgtaataacccatatggggcagggggagaaataagtggttttttaaatttacttttgccagtatgtgttaatagtacttagtttcataattctggatgtggctccagtaatcagaagagctttaaacagaaagatcaaagtccatagaaaagagttttgtttccgtttccttagaatatagatcatcctgtgaaaaacataggatttcttcaaggtaaataaatagtactcacaggaggctaaggcagagaaactataatgacaagtagttcaagtgtgtaaagaaaaatactggttattaggaaagactgctcagatgggccagtataattaaaatagttaaagtgacaagggattgatctgaaacaagtcatgagaatccctacaaaaagcagttccctaaactggctgcataagaaccatctggagtaataagcttacgaattaaactgatacaagcctgtctgtacctgagacagccgatatccagtctgggcttcttttcagtaagagaattctgattttattgctggtaatgtatccagctaaaagcaatgtttctcagcttctcctgaagattggtatggccatgtgactaattctggtcattgaatacaagtggagattattggctattacttctgaaaaggctctttaaagagggaggaagagctgagtttgaactttttgcctttctacccattcctccttctatgtagaatttagaccttaaggctgaatctgtagcaaccatcttagagcatgaagcaatcttgaaggtgggagtcacaagttaaagatggcagagctaatggattaaaggagtctgggttcccagccaccatgggactgccatgccaaccctgcactgctccttccacacttgttttataagaaggaaagtaaacctaacatagataatcctgttactatacaccatcaaatcctaaacacagtgctactggcattttcttagccttaccagattgcaacagatgattttcattttcaggcaagtataactacctccacaatgctacccagctgtcagtgattacagcataccatttggggaaatgcatgtcttagaattaatgaaacaggtatttagagtcttcagtttatccagctgccttagcttgcctgaaatcttactagtaaactcactgattctgggaccatccagaagctggaaattcccaatgtggaagagaaatggccatgagagaatgccttgtgcatacctggcacagaaaggaagctaaggaaaagcaatccaacacagacattgccacccacagttgtatggaaggcaaagtatcagtgagaaagaagctgtagtaacatcagtgttggagaatctttatttattatagggttaacctcttgtaccgtaatggaccttaaatgagcacagaagtctggtctccaaagtgagacctaaaggaagatgatgccaaccagagcatggaggacagactggaagttttcccctggcacaggccatcagtaatcagctgttgatatgcctatgttaattgtctggtaaactcgtggtgctgttttggctcttctcaactagttcactttttaaaaatttaagcacctcattaaagaaacccttttagatgtggtaaagcgaaacagtctactaggtagggccctactaagtaacgagagatcatcataatactattcagagactattaaaatcgtcgactcttgggttggccatgctaagcaactggtatagaaataagccatggcggggttagatttacagtttgagcacatcactgatttcctatttatatctctcccccataataccagatacatggtagtcactcaacaggacaaatattaaataacaaatgacacaatacatggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaactagaagacagatatattgttagataactgttgccatcttgtggcaaaccacaaaacagtcacttagaggcataccttggagacagtgtgggtttggttccagaccagtgtgataaagcaaacatctcaataaagcaagttacatgaattcccaggtttcccagtgcatataatagatatatttgcattatactgtagactattaagtgtgcaatagcataatatctaaaaaggcaatgtatataccataatttaaaaaaatactttattgctaaaaaatgctaccaatcattcgagctttgggtgagttgtaatctttttgctggtggagtcttgattccatcttgatggctgctgactgattagagtagtggttgctaaagatgggagtggctgtggaaatttcttaaaataagacaacaatgacatttgcaacatcaatttatttctttcatgaaagatttctctgtagtgtgcaatgctgtttgacagcattttacccacagtagaaattatttccaaagtggaggcaatcctctcaaactctgtccctgctttatgaactatgtttatagaatattctaaatcctttgttgtcatttcagcaatgttcaccaggaatagattctgtctcaagaaatcactgtttgttcctccgtaagaagcaacccctcattcattctagtttaatcacgagattgcagcaattcagtcccatcttcagtctccacttctcattctagttatcttgccatttccactacctctgcagttacttccttccctgaagtcttgaacacctcaaagtcatccatgagggttgaaatcagcttctttccaatttcaattaatgtggatattttgactccttccataaatcacaaatgttcttcatatcatctagaaggataagtcctttctagaaagttttcaacttactttgcccagatgcatcagaggaatcactatctacagcaactagagacttacaaattattcttaaatgatatgatttgtaagtcaaaactactccatggactgatccatggactgcggaatgtatgttgtgttagcaagcacaaaaactttcatctccttgtacatctccataagagctcttaggtgatttgatgcactgtcaatgagcagtaatgtttgaaaggaatttcttttatttttctgagcagtgggtcctaacagtgggtttaaaatactcactaaaccatgctgtaaacagatgtgttatcatccaggctgtgttgttctatttctagagcacagagtggattcaacataattcctaagggccctaggatttggggaatggtaaatgatcactgacctcaacttaaagttaccagctgcattagtccctagtaagacagtcagcctatcctttgaagatttgaaaccaggcattgacttctctctagtatggaaagtcctggatggcatgttcttctaacagaaggctgtttcagctacacttaaaatctattagtttagtgtagtcaccttcatcagtgatcttagttagatcttctggataactttctgcagcttcccatcagcacttgctgcttcacctgacacttttatgtcatacagatggcttctttccttaaacctaatgaatacacctctgctaatgtccagtttttcttctgcagcttctttacttctgtaagccatcatagaattgaagagagttattccttgctctgaaataggctgttgcttaacggaatgttgtagctggtttgatctttctatccataccacgtaaattttattcatgtcagcaataaggctgttttgctttcttattatttgtgtgttcattggagtagcccttttaatttccttcatcaatcctttctttgcagtcacaactgggctatctggcaaacaaagtctagcttttggcctgccttgggtttcaacatgccctcctcactaagcctaatcatttcaggcctttgatttaatatgatagatgtgcagctcttcctttcacttgaacacttagaggccactgtaggattattaattggtgtaatttcaacattgttgggtgtcaaggaatagggaggcccaaggagagggagatggaaggatggctgatcaggggtgcagggagaaaacacacacaacatttgtcaattaagttcaccattttatacgaatgtggttcatggcgtcccaaaacataatagtaacatcatagatcactgatcacaaatcactataacagatattataataataatgaaaaggtttgaaatcgtttaaaaattaacaaaatgtgacagagacaggaaataagcccatgctattcaaaaaatggcactgacagatttgcttgaggcagggttgccaaaaactttcaatgtgcaaaaaacctagcatttacaaagtgcatcaaagcaatgtgcaataaaacaaggtgctcctgtaatagaatgctgggaggggtggtatgatcatttactttggatgtttaaaggttttagtactgatagcttaataggaatatctagttctttcaggcatcaacaagagtaaaagtactgaagtagtatttttctccaactgaatcaatcagtgggatggaatttacctcattttatgttctctttctccttttccattacctgctctctatgcttcacccaacccattctttcatgacctcaagtttacccagcaaaatcttcacatctaccatcacctgtaccagaacttgtatttctctaatttttcagtggactaaatccttcacgttttaccttatatcttgctaaaacacttttgctagctaatcctagtttattctagattcctttattatcatctctcatcatatattctactttctctcttatttcatagcattttttattatttgtaattatttagtcatctgtgtgattttttgttgtttaatttaaggatcccctctttctagaggaaaagccccatgaatggaaaagccccttgaactgtgcctattttgctcactccaggatgagtattatttcttagtattatttctttaaactgaacaactctagtaagattccattcttatatcagaaagtaaaatgactataagatagcatgagacattaattttgtgacaaaagttataaatgtagcattggttctaagagatgaaatccttgctcttctgagggtctgcagagaacaacgaacagagctagacaaatataatttggaggtaagaatgcaaataaaaaactcaaattattaaattatgtatgtaatacatccagttccaaatgcaaaagaaatagtccttgattttcatacactaccatattatcattttatagaaagatttccatgatttattttaaaatgcacaggatattctctctcttacacacacacatgcacactcttttttttttagatggagtctcgttctgtcgtcaggctggagtacagtggcacaatctcggctcacagcaacctctgcctcccgggttcaagcaattctcctgcctcagactcccgagtagctgggattacaggcgcccgccaccacgcccggctaatttttgtagtttcagtagagacagggtttcaccatgttggccaggatggtctagatctcttgaccttgtgatccgcccgcctcggcctcccaaagtgctgggattacaggcatgagccaccgcacccggccatgcacgctcttttgagcacaaacacacacatacacacagatacaaagacacagacattgaacagatataaatatatactatgtcaaataactattgtcaaaattttaccaattttagtgtaccagttttagtttaacccaaaaagctgtcactgtttagaactttgaaataacaaaatgctatttactctaataagttattcctcttccaaatgtggcatagacacaaaagagggagaaaaaggagaaaaagtcctatagggacatactataacataagacaagatgtaccaaccacaaggggaatagagatagaggaaaatatctctatttcagcaaaaacaaatcatttcaccttcaaacaatacgattatgttttaaagaaccagtgaggatcagtttcaaattactattagtgtaaactactcaagtagaatgatctgttgaaatgggattgttctgaattacaacagaaaggccttccacactgcggaaagcagaaggccacccttagttaacttataatccagatactcatttccaaattttaaattaaaagaaaatacaaattttaagcttcttaccatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctagaagaagaagaagaaaatatcaagtgaatagttttttttttatttctggatgatatcaaagataatcatcaatgtccaacaaggtcttcattttagtgcatcagaaggattttaagagcatgtcacctgaaaagtctcattccactgaaatcaagaagtaagcagacttttacaatatgaacagagctccttacctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctagcagaaaatcaattaaaatgataaccaacatttcttgaaagtctcagaaatacagacaagttggagatgggttgtgcttgagaaaaacaaattgttccaacagaaagtcttttagagtaactaggaaaccctaataatatataacagagcaaagaaaacttatggttgagagaaaggaaattcatcaactgacacacctcgaataagccactaacagatattttcctttactttccctttaaaacaattcttttgacttgtataaacttcttcctactgcctttctaaaatgtagcagatattaacctaagaaatttatttatacacaagatttaaaatgaaggaagttattcaaagactaaacttaaagtcttttttatgttacaatttaaatgtgaaatccacaactagagcatgatgaatgacatcagcaacatttgttctaacccctcctatgccaccatgtgacagggagcaagttatcacagagttccttcaactgtgaaatgaagacattgtactaaatgattcatttatttatcaacaacttattgagtttccattctgttccaggtaccctgtggagggtttaggctgtaacaatatggtctctaccagctccaaagcttaattattttcttaacaaattgcatgaagtgtaaatggaacaggctagcctttacactaacacttcctttcatgtagaaacaattaaaaaatagaaaatcctgtgatggactctttgtaggaatttagatttccagaaaatttacaaaattgtacaaaatcaaatgacaaatgccaactaaaacactttccagaagttgtagaaaaagataaaatgcaaattcatttttaagtacaaaagcactttgcaattaactggagaacattttattcctaattctcctcctctcacctctacctaagcagctaatcattacatttattgaacttctgaaatttgtaaaacactctgttgaatgctataggaaatacacagaaatggaaaacacagcttctgtcttcaagaagtgtatttacattggagaaacaagtcataatatatatggatacattaaaaaaaaaacatgcaatatatatccaacagagaggggcttacttcagagcaaccatctaagaggttttacagttactccaatatcacttcaccactccaaacactttggggaccaacactttcagaatcagccttagatcctgcaatacatctctttactatttcgttagtggcaaatctgcacctttggatttttgtttgtttgtaggcacagataaaagcatttggagcaaatatttttttaattaatatgaaatgaatgggaaactgttagtaataggattcatcatcattgtcatcaccaatgtggtcgtagtagaaatagtaacagcaaaggcacatagcatttataatgtgctaggcactgttctaagcacttcaaataccgaattcatttggaacaattctatgaggaaagtacaactgttaccatcattttatagttgaggaaattaaagcacaaaaaggttggtaaacttacccagagatacaaaaaaagagtgaatgggcatttttggcaacagtgctttactactacacacatatcggggatgggaattcttctctgtaataggatctgaaggtaattcgcaaggagacttccccacctctcagaaaactcttctgaacgcttgatgcaacattgagtaagtatcaaatcttttttattttaagaaacaaagcttatccgcataaaaaattctatcttttcttaaaatgtgggctttttattttatagctgtatcttaaacgcacaacacaataaacaatcataatttagcacaggtggatcgggtagtttgcataaaaaatgccccagagcgggaagcaattacagctgaaggagaaacaaaggtggtcatagggaaagccacagaggaagtgacctgggctttgtaaaacttaatgccgtgatatacttaatgagattattttgaattaaagcagttgttttcatcttccaatctaatttgtctaattacatgtttaaaatttccttattgtgatgacttcagaagaagactacaaaaccaagtcttgactacctgatatcactacagagtctgtatacaaacacccttaattttacagaagaaattaaattaatatatcaggaatgattctcatacctctaagtacagatattattgactctatttattatgcctcatgctttggtcccaaatgatactgttgagcaggtaagagttatacatttttaatagttttggaacaaaccaaagtcagcaaaccttcacagaaacttcttttttaattcacctagaattaaatcactgagcagagagaacactaaattcaagttcctgtagttaaattagtgaatatgcctatctctctctttcctttttaaatttttgttttctattgttattgttgttcacttgcttgctttcttgtctgagttttactctaaatatgaggctatttctatcctcagccatgatgaggcaattcagcctagtgaaaagacactaagtctggaatctaaaactgagttcaagcttggctgtgagaagaattaccgtgtaatcttcagcaagacttgtaacacctttcacttagttattaatggggatggaagtcaaagcaatgtgtagtgttatcagaatgggggagaaagaatatcatgcaccaaagttaaaaaaatagagggagactatgttgaatcccaacataaattggagggcaaaaaacaaaatttttttcaaaaaaagtacttagaaattaaaatggagaaaacaaatgggcttattgcagaacagtttaaggaaggaggagaaagttgtagaggatgaggaggcctgggggaatagggagcacaaggaaagggagaagtagcatgaggaggaggaggaggaagacaagtataaggaggatgagaaggaggatgaggaagaggatgaagagaaggatgattaggaggaggacaaggtggagcatgtggagaaggaggaaaaggaaaacagggagaacaaggagaaggaaacgagcaagcatgagtaagaggagcaggaagaggactaaaaggaggagaaagataaggacagacaagaaggacacaaaggaggaggtgaagaatatatggaagagtctcttttaataagtacagaatgtgaatctaattctattccactaaatctcataaaaggccatcacagaggatagcttcagtaataaagtgaacaagaaaatctgattgtcactcagtatccttcatcaaccatccaaatgtttgcttaatggacccacatataaagcacagagtggtgcagagggaggatatatataggttcagcattctcttctcctaccagggggaatctggctttccagcactaaagaagtcccaaacttcaaaagccaaggctgatgctgagcccccaaaaagctatcactgtccaacagggcaagaggaccaggtggctgtatgtggtagcagaatgattccactggattcctcccattataaggggatgctcttggactcacaaagatagacatatacaatatatgtcttccctgccttcagtgcctctgcaagcaccatcattcatggacttatagtgcaactgatatatagccaaggtttcctgtgaaaactatctcctaaccattttttagcaaaggaagtgagacagtgggctcaatacatataattcatggatcacatcacctgcaccctctagtagcaaccagtttgacagaatgatgaaatgtcctgatgaagcctcagccagggtgcaagccaagagataacaccctgagaggttggagttctgttcataggttgggcagccaagtatatggtgtcatctctgctgtagagaatgcacaaatccaggaaccaagaggtgagagtaaaaggggtataagtcaggctcaggggctcctgccagtaatcccagcactatgggatgccaagggggaggactgcttgaggccaggtgttcaagaccaacctgaacaacataactagacctcgtctatacaaaaaatatattactttgggaggccgacacaagcagatcacgaggtcaggagatcgagaccatcctggctaacatggtgaaaccccgtctctactaaaaatactaataaaaaaaattagctgggagtggtggtgggcgcctgtagtcccagctactcaggaggctgaggcaggaggatggtgtgaacccgggagacagagcttgcagtgagccgagatcgcagtgagccgagcctgggtgacagagtgagactccatctcagaaaaaaaaaagaaagaaagaaaaaattacccaggtatggtgtcatgagcttatgttcccagctactcgaaaggctgaaggagagttacagtgagctatgattgcgccactgcactccagctgggcgacagagttagaccttgtctctaaataaataaacagataaataaagtaatctatcttatttttatgcctaatacaccacttaaagaattcttactgacaggccagatggccaagtaggaacagctctggtctgtagctcctagccagaccaacgcagaaggtaggtgatttctgtatttccaactgaggtacccagttcatctattcaggatggttagacagtgggtgcagccctctgagggcaagcagaagcagggtgaggacccaggaagtgcaaggagccggggacctccctcctggagccaaaggaggccatgaggagccatgccatgagggacagtgctctccagcccagatactatgcttttcccaaggtctttgcaacctacagaccaggagattccctagggtgcctacacctcaagggccctgggtttcaaccacaaaactgggtggttgtttgggcagacaccaagcgagctacaggagtttttttccataccccagtggtgcctggaacaccagcaagacagaatcattcactcccctggaaagggggctgaagccagggagccaagtggtcttgctcagcgggtcccacctccatggagcctggaaagctaagacccactggcttgaaattctcgctgccagcacagcagtctgaagtcaacctggggcactcgagcttggtgtggggaggggcatctgccattactgaggcttgagtaggcagttttcccttcataatgtaaacaaagcctccaggaagttcaaactgagcggagcccaccacagctcggcaaagccactgtagccagactgcctctctagattcctcctctctgggcaaggcatctctggcagaaaggcagccgccccagtgagaagcttatagataaaactcccatctccctgggtcagtgcacccacgggaaggggtagctgtgggcgcagcttccgccgacttaaacgttactgcctgccagctctgaaaagagcagcagatctcccagcatagtgctcgagctctgctaagggacagactgcctcctcaagtgggtccctgacccctgtgcctcctgactgggagacacctcccagcagggctcaacagacacttcatacagaagggctccaactggcatctgatgggtgcccatctgggacgaagcttccagaggaaggagcagacagcaatctttgctgttctacagccaatgctggtgatacccaggcaaacaggggatggagtggacccccagcaaactccagaagacctgcagaagaggggtctgactgttagaaggaaaaccaacaaacagaaagcaatagcatcaacatcaacaaaaagaacggccactcaaaaactccatctgaaggtcaccaacagcaaagaccaaaggtagataaagtcaccaagatgagggaaaaccagcacaaaaaggctaaaaattccaaaaaccagaatgcttcttctcctccaaaggatcacaactcctcaccagcaagggaacaaaatcagacggagaataagtttgacaaattgacagaagtaggcttcagaaggtgggtaaaaacaaactcctctgagctaaaagagcatgttctaactcaatgtaaggaacctaagaaccttgaaaaaaaagttagaggaattgctaactagaatagtcagtttagagaagaacataaatgatctgataaagtcgaaaaacacagcacaagaacttcgtgaagcatacacaagtatcagtagccaaatctatgaagcagaagaaagtatatcagaaattgaagatcaacttaataaaataaagcatgaagacaagattagagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagcaagataggccaaaattcaaattcaggaaatacagagaacaccactaagatactccttgagaagagcaactccaagacacataatcatcagattcaccaaggttggaatgcaggaaaaaatgttaagtgcagccagagggaaaggtcatgttacctaaaaagggaagcccatcagactaacagcggctctctctacagaaactctacaagccagaagagagtatgggccaatattcaacattcttaaataaaagaattttcaacccagaatttcatattcagccaaactaagcttgataaatgaaggagaaacaaaatcctttacagacaatcaaatgctgagggattttgtcaccaccaggcctgccttacaagagctctgaaggaagcagtaaatatggaaaggaacaaccagtaccagccatggcaaaaacaaagcaaaatgtaaagaccattgacactatgaagaaactgcatcaactaatgggcaaaataaacagctagcatcataatgacaggatcaaattcacacataacaatattaagcttatatgtaaatgggttaaatggcccaattaaaaggcacagactggcaaattggataaagagtcaagaccgatcagtgtgctgtattcaggagacccatctcatgtaagaagacacacataggctcaaaataaagggatggaggaatatttaccaagcaaatggaaagcaaaaaaaacaaaaacaaaaacaaaaacaaaacaaaaaagcaggggttgcaatcctagtctctgataaaacagactttaaaccaacaaagatcaaaaaagacaaaaaagggcattacataatggtaaagggatcaatgcagcaagaagagctaactatactaaatatatatatgcacccaatacaggagcacccagattcataaagcaagttcttagagacctataaagagacttagactcccacacaataatagtgggagaatttaccaccccactttcaatattagagaaatcaatgagacagaaaattaacaaggatattcaggacttgaactcagctctggaccaagctgacctaatagatatctacagaactctccacccccaaatcaacagaatatacattcttctcagcaccacatagcacttattctaaaagagaccacataattggaagtaaaacactcctcagcaaatgcagaagaacggaaatcataacaaacagtctctcagaccatagtgcaatcaaattagaactcaggattaagaaactcactcaaaaccacacaactacatggaaacggaacaaactgctcctgaatgactactgggtaaataacgaaattaaggcagaaagaaataagttctttgaaaccaatgagaacaaagacacaacgtaccagaatctccaggacacagctaaagcagtgtttagagggaaacttatagcattaaatatccacaggagaaagtggaaaagatctaaaattgacaccctaatatcacaattaaaagaactagagaagcaagagcaaacaaattcaaaagccagctgaaggcaagaaataactaagatcagagcagaactgaaggagattgagacatgaaaaacccttcaaaaaatcaatgaatccaggagctggttttttgaaaagattagcaaaataggtagactgctagccagactaataaagaagaaaagagagaagaatcaaatagacacaataaaaaaaatggtaaaggggagatcaccactgatccacaggaatacaaactaccatcagagaatactgtaaacacttctacgcaaataaactagaaaatctacaagaaatggataaattcctggacacatacagcatcccaagactaaaccaggaagaagtcgaaaccctgaaaaggccaataacaagtcctgaaattgaagcagtaattaatagtcttaacaaccaaaaaaagcccaggactagagagattcacagtcgaattctaccagatgtacaaagagaagctggtaccattccttctgaaactattccaaacaatagaaaaagagggactcttccctagctcattttatgaggccagcatcatcctgataccaaaaccaggtagagacaaaacaaaaaaagaaaatttcagcctaatatccctgatgaacatcgacgcaaaaatcctcaataaaatactggtataccaaatccagtagcacattaaaaagcttatccaatatgatcaagtaggcttcatccctgggatgcgaggatggttcaacatatgcaaaccaataaacacaatccgtcacataaacagaaccaatgacaaaaaacacatgattatctcgatagatgcagaaaaggccttcaataaaattcaacaccctttcaagctaaaaacactcaataaactaggtattgatggaacatatctcacaataataagaactatttatgacaaacccacagcccacttcatagtcaatgggcaaaagctggaagcagtccctttgaaaaccagcacaagacaaggatgccctctctcaccactcctattcaacatagtattggaagttctggccagggcaatcaggcaagagaaagaaataaggggtattcaaataggaaaagaggtagtcaaattatctctgtttgcagatgacatgattatatatttagaaaaccccatcatctcagccccaaaactccttaagctgctaagcaacttcagcaaagtctcaagatataaaatcaatgtgctaaaatcacaagcattcctatacaccaataacagacaaacagaaagccaaatcatgagcaaactttcattcacaattgctaccaagagaataaaatacctaggaatacaacttacaagggatgtgaaggacctcttcaaggagaactacaaaccactgctcaacaaaataagagaggacgcaaacaaatgaaaaacattccatgctcatggataaaaagaatcaatatcatgaaaatggccatacagtccaaatttatagattcaatgctatttccaacaagctaccattgactttcttcaaagaattagaaaaaaactactttaaatttcttatagaaccaaaaaagagcctgtatagccaagacaagcctaagcaaaaagaacaaagttggaggcatcacgctacctgacttcaaactatcctacaaggctacagtaaccaagacagcatagtactggtaccaaaacagatatatagaccaatagaatagaacagaggcctcagaaataacaccacacatctacagccatctgatcttcaacaaacctgacaaaaacaagcaatggggaaagaattccctatttaataaatggttttgggaaaactggctagccatatgcagaaaactgaaactggaccccttccttacactttatacaaaaattaactcaagatggattgaagatttaaatgtaagacctaaaaccctagaaaccctagaaggaaacctaggcaataccattcaagacataggtatgggcaaagacttcatgactaaaacacaaaaagcaatggcaacaaaagccaaaattgacaaatgggatctaattaaactaaagagcttctgcacagcaaaagaaactatcatcagagtgaacaggcaacctacagaatgggagaaaatttttgcaatcttatccatctgacaaagggctaatatccagaatctacaaggaacttaaacaaatttagaagaaaaaaacaaacagccccatcaaaaagtgggtgaagaatatgaacagacacttttcaaaagaagacatttatgtggccaacaaacatatgaaaaaaggctcatcatccactgatcattagcgaaatgcaaatcaaaaccacaataagataccatctcatgccagttagaatgtcgatcactaaaatgtcaggaaacaacagatgctggcaaggctgtggagaaataggaacacttttacactgttggtgggagtataaattagttcaaccattgtggaagacagtgtagcaattcctcaaggatctagaaccagaaatgccatttgacccagcaatcctattactgggtatatacccaaaggattataaatcattctactataaagacacatgcacatgtatgtttactgctgcactatttacaatagcaaagacttggaaccaacccaaatgcccatcaatgatagaatggataaagaaaatgtggcatgtatacaccacggaatactatgcagacataaaaaaggatgagttcatgtcctttgcagggacatggatcaagctggaaaccatcattctcattctcagcaaattaacacaggaacagaaaaccaaacaccgcatgttctcactcataagtgagagttgaacaatgagaacttacgggcacagggagggaaacatcacacactggggcctgttagtggggtggggggcaaggggagggatagcattaggagaaataactaatgtagatgacgggttgatggatgcagcaaatcaccatggcacatgtatacctatataacaaacctacacgttctgcacatgtatcccaaaactttaagtataataataaaaaaaaaaagaattcttgcctcctgtccccgaaaccttggacttgatgagtttgatggccctactgtccaaggcagtaattcttataccaggaaacatggtcattttctgattcactggaagtagagactaactcctggcaatttaaatttatttatggccctgaaccaacagagatgagaaagtcactataactagctagggtaatcacacctaatgatcagggggaattgattttctgctacagaatgaagacaaggacagtgcttaaaactcagggaattcagtgggatgcctcttagtactcccttcccgatagtcctggtcaagggaaaatagcaacgatcccccaataaaaacaagactaccaagcactcagatcttaaagaaatgaagatttcaattgccctaactggaaaatgactcatccagtcaaggtgatgtcagacagtaaggtaaatacagaaggtattgtcgatgggggggccctataatgagcagtttaggcctcatgaccagctccagaagtgagctgcagctataattaatgttccttaattgcatcctcttctcccaatattttatatgaagagtgttgctggggaccaatattttagtcaggttgcagtattagtaaaagacatcatgggaatgatatggtagttgatgggattttgtgcataccctgtgttaggaacatgcatttgtcaaccacatggaggacaagattggaggttgatagagagaaaagtggtagagtattcaaggtatctttcatttctccctccagatccgctttccgctcttctttccccataagacctgcaggcactctatcaaaggccctcatgtccaggtgctcagcaggttccagacagtgagctctaacaaaattggagggaaggaggagtggggatcgggatatttattcccttggctccctccttgaaggttaacttaggctggctatgtccacaactaaagatcactgttccacgtacagtagctttctacacaaaactagctcctttcaagttctagagaaccttttttcttcccttttccctttggtcataggttgttgacagctccactgttactagcctcaggttactgccctgtggttcacctacactgtgctcagagttttacaaagtgtctctcccctatttattatttatccttatttgagtaggccatctctctctggaaaggatttgacatatccaaagtctaatgctcattccacaacacaatactatgaactatatatactgttaaataagttttcatgaaaaaagtaacaaaaggattacatagacatgaatatattaaaaagagttaaacgcattctgtaaacataaagttttgataggctttgctttcattactaggttttccagtgataaatgtttgtattttatagctggtgattacttggtccttctccttacctgaaaagtcagctaactaccaaaatgaagcttcacatgagaaaagagaaattatttatcctttaatgcatgtaaccaaatataattcaaatgcacttaccttccagtcattcagtttcaggtaaagctcaaaactatttccaaaactctctttgctaattaaaataaccattaacaagaaaataacaatttctagaaacctcgcaagttgtttcctgtctctccaatcctgtggaatgtgagtaaagttgttttggtctttagtagtttaattaataatcagttattttcagtttgggaccatagcatttttactgccttgaaaagaacaatttaggagaaacctgagaggttttcaagaaatctgctactttgccaatggaatctaaagtaaataatagttaaatatttatggttatcctaatggactatttataccactctaaaaggctgcttactgttgctacagatgaggatggcattaatgcactggtacattcaggacacaggatatcatttcttataaaaagcccataaaatgtacctccccgcctacacaactctcattcttactgcaacatcttaaagggattcaggaggcaccaggaaattgtttaaatttcaatgtaagttggagaaatcagttgctaggatccttaaaagtagtgtttccaaaatataggaatatctacactgatcagcctcaaggctttcagaataattcatatgagaaaacaggggtaggatgggatgccgtggagaaaccaaccccgtgcagcagctgcctgtcatgtcttaacatttgacatgaattacatcaagaactgaaatattcaagatcccactcaatatactccatgtgactcacctgcaaaaaaagagagactgctttctgtggcagagaagatctagaaacacacggtcaaggagcttagggaaagtggtaagaggcaaagaaatagatgagaagagagattagagccagtggtaactgcaaccaccatgacagaacaggcacttaggaccaagtgggggtgataaggaataggcaaggtgccaacagagagacaaatataaagctattctctgcaaggggcaactggcaccctggtttatatttcaatagttcagaaaaacagaggctgtctctactctgtacatggagcgtgagaagtaggagccacacaagataagggtaccaggaccacattccctctgaaagctgtcactgtgccactctaaagatgtgctgacccgtttaagaaaagaagaatcgggcatgaaatatacagaatacaccactggagcacagagcagtagtgataataatatttatagtaataacagagcctcctgccgcattctcactatgctcctggtactgtcctacgcattttacatataccatcgtttaatcttcacaactgccctatatagatattatccccattttacaaatgagggaactgaggtatagaaaggttaggtaaattaaccaaagtcatacctctagaaatgtgcagaaacaggatttgagcctccatgccaaagaagctaagcctgtgatccccaggagatacaggattttattttctgtgttgttggttcctgttcacccagaatgtagtagcactgtaggcactcagtgagtgtttgttgactaaataaatgtgtagtaatattaaaagtacatcttctctcatgacatgttcacaaatcattgtcccatgaagcatgtattccagtctttccaaagagcaaacacatggacatttatgcacaacatggaaaggatgtgcataaaaaaagttcattaatcaattccaaattggttcaccaatataacataaaattcagtgcagagatgcttttgttgtttgtttgccaattcttagctactgagagttgaagaactggattaaaatctcctggcaggacaagatgtttttttcctttttggccgagaatttagcgtttaatgggtgttcaataaatattatttttaattaaatggtgggggggggtgctgaattaagtagagaaatgaaatatcaaaatacatttcagtcaatggatctcagaggcttcctcctctattctagtgatcaaggcagttttttgtttgtttgtttgtttgttttgagacggagtcccactctgtcgtccaggctggaaggcagtgacgcaatcttggctcactgcaatttctgcctccccggttcaagcgattctcttgcctcagcctcccaagtagctgggactacaggtgcgtgccaccatgcctggctaattttttgtatttttagtagagacagggtttcaccgtgttagccgggatggtctcgatctcttgacctcatgatccacctgcctcagcctcccaaagtgctgggattacaggcgtgagccaccacacccagccctcaaggcagaagacttttattggcaaccatcttgcatctaactttgtggacttacatattttttcagaagatggtttggaaagggagggcataaaagtaagaatattagcaatgaaagcagataacctgttaaagatttattgtttgcaagatgcttttctaaatgcctgtgataagtacatcatcctgattacagaggaaataaatgaggacactggaagaagggacttgcccaaaacgacacagctagaaaatgggaaagtcaggatttgtgcccagactatttgactcctaagcctatgcaataagaggtcaagatactgctcaagagaattgagtttttcagatgaggaatttctgaattaagtagcttgttgctataaggtaagaaattattattttattgctgtttgccagtctccatcctggaaggtggagtacctccaggattcaagtacctctggttttgagtagaagacactgaactaatgtgctgaggtgttctgaggattgctaacacttcacacacaattaaaataatacttccaattgttgaggagaaaaaaaacaccatcctagagctttcaaatccactacatataatctactgtttacagattgcaaaaactgattgcaaaagacagttgttttcctgactgacccgttcttagtttataacatttaataaaatgtaattttggagccaatgtcttgtattattaacactgtttaagtgttagaacacaggaatgcttactttgaagaagaatttctatctagaatgttttccaatgtcattttatacaagcatccactgtgcctacctactctgttcatctttctgttcctaaaacccactgaactgtttcctaccatagagatttctcactggctgtttcctcagccataatattattctctcggatattcacatggatggttccttcttacaattctgattttaacttaaatgtgttctccttgaggaagtcatccctgaccacccacactaacatagtgacccagacatcatcatatcacattttaattccctgcaggacattttaaaatttatttttgtattttatgtgtataaatgtatggggtacaactataattttgttacatgtatagattgagtagtggtgatgtcagggtatccatcacccaaataaagtatattgtacccattaagtaatatcttatcatgcaccctcttccctcctgctcacccttctgaatctccattgtctatcattccatattctatgtccacatgtacacattagttagctcctacttataagtgcctgcatggcatttgtaactctatgatgttgggctgtgtgtcccactagaatgaaccagaatggcagagcgcatgaacattttctgtctagtttgtcatggaatttctaaggtgtagagcagagcttggcacttggcaggtgatcactgaatagatgagaagaaaataaatgatgaaatgaatgactgaataccatcttcctacgctttaatatagcatcactgatttaatgtatggaccaggatatcattcagaatataaaatgttgtcacaaaagtagcctgatatatcacagaggcccagtttaagattgccattattgttttaatataaaagttacatgattctgggattttgatcaaagtcacaaacactataaaaattacaaaaaaaatacagactatttttgcaaaagtgatgtttgtccagaaaagaatgtttgagattctactttctaaatggaaataatctctagatttgggtgtttgtttgcaacccaggaaactataatgatggctgatccctcacttattttttccaatatatattttgtaacctggtaatagaggaggatacactagaaagcataagaccagaggccggaatgtcttatggaaccctccaatgtaatctctattggtgtttcctctgctgctaaacgtttctgacttttatccactttcactaagttggtataaaggttcgataaagtcatgttcattaagcactttgatattcctaagtagaaagagattcagtaaaataaagtctgttcttttattttacttttaatgttctgatacctgataacaaataaaaagtaataataccttaatcacttcgaaaaagaattaggctcacacattggtctctctttctacttattaggattcaaaacttctataataatacttctaaataaattgagccaataattagcatggagagcaaagttaaaggcaggagaatgtcaccacttaatttaaataaatgaagagttattaattgaattgagagccttagaatgggactgaaattctctatctaagaagcagacatatagtagaatcaaatttcactacctaatcaatgccctaactctaacccttaatacttttattaagagtcagcacttaaattgttcttcaaatatcttcaattctttttttattcactaagattattagtgaagtattaatagttataaaagtgaaatttgttatctggaaatttacctcagacacaaaactgaatagatatgattgtagagacaaataaatattatagatgagggtgtgtgtgtgtgtgtgtgcatgtgtgtatgtgtgcatgagccagtctgctaattactatataatatagtaatgtcaacctcaaaaagcagtttggcaagaccacacttcatttacaggatgcattagctttggtatctttttgatttagaatccttactttgaatatatagaataaataaaatggaataataaaatgtagagtaaattctgcctctgcaagtgcttcttcaagggagatggatttcatttattacaataaaacaccttatggtttggcaaatctttcatcatgcaatccactgagtaaaagttactcaccaggtcttgattcagtattcccaaactgcagaatgcagcatgcaaagaatagagcacaatataaatatttttaaataagcaaatagcagaagccaaagaaaacaaagtggtctattttagtcatccaacaattatgaaatggacatcctttataaggcaatcttttaaaaagctgatgttaaagactgaccagcaatagaataagtatttaaatattccattgcttcccctggtttgccactgggctttccacacagtagaataagcaattctttctgatgagcagaataatttacttgaacctcatatattattggttcatttttcaagagaaaaatgtattggcattcattattaactttttttatcaatcagcatgcatgacagaacaacacagcaattcttcattacactaatggaggaaaaattaacttgacatcaagcctaattgactaaaacctcactaattcttctaaatagggataagtcctgcttgattagtgaaagcaatttagtatagaacatgtttagatagatgcacttttattgctttccagaacttaacactaacaaactgggctctccagcatcaaaggcgagataacggtagaggttcttcacaaaacctgccacagtgtatggataagactaacacaacatatcaaacacataataacaacttggaatttctctagataattgagaagctttaggtgcaatcttgccaaaaaaattgtttcaaaagaaatttttacagatgctgccaaaatactctatagccaagcccatagcaaaataaaacaaatcataaattatcagctatgacagactggtaatcaaaactaacaaggtttcactatgcgggcaatcctcaactcactacaagttgttttacaaaagttcatttgtaagctaattgttagaaatcataacttattacagcaatattctcattaggaaattagtatcatgtatatggagcaaacatgagcttgggatgcaagaccccagaaggggacctcagcatagttttgctgtttattatctgtgtgaacttgagggagtcactgtacttaactggatcttaatttatgcagctgtaagttgacttaataccaagttcatagtgctattgtaggaatttaatataataatagctaaaaagctaccccagtgccctctactcttacccatagccatttatgttcctttttcaagtatttctctatatcagagagtattggctggcaggtcatagaggagcatcagtgagttcatgaacccctttaaattgtatgcaaaatttggtaggtctgttgcaacaggtaatgggcttcatcaagcggctgtctaagggaatgattaaaaaccattgttctatagccactttcttgaatgtttcaaaattagaaaatgacaaatgtttaaaaacaatgactggaagcactctctgcacttaagttgctgttctgcccaactgtattatcccagtaaagtcttacatatctgtcaagatggatacaagcatgattttctcagaagagcatccttgaccatttcgctttcatcatgttccatcccaatatgcgccactccatttgcatcacgtcccaccccaaaacacaccacgtctctctcaacatagtaacttgcatatgcctctactctagtactcatcacactacacaataactattttttatgtcagtaagttctagttttatatgctcaaaaatttctagtcaaataaatatgaattttttcacaaaaataaatgtatacttagattttatttaaagtagccattttaatcgatgagaagcatacaaatcaggaagtaattttgcttttttaaaagaactctgagtgtaacaaatctaagttcaaatcgttactctgatgttaaacctccctgaaattcagctttcctatctgtacaatcaagataattacacctaaatgaatgttgcatatgaataatatttacaaagtatgggtatatttcttgcacgtgacaggtaccaccagcatcacaccaccaactaccaccattattatttctattagttattcaggagtgacaggtacaggcatacctctttttcctgcacttcactttattgtgcttctcagatattgtgatttttacaaattgaaggtttgttgcaaccctgcattgagcaagtctatcagcaccatttttctatcagcatgtgctcatttcatgcctctgtgccacattttggcaattctcacaatatttcaaactttttcattattattatatctattatggtgatctgtaatcagtgattttgatgttactattgtcattgttttgggacaccatgactgtgcccccataagatggcagacttaaccaattaatgttgtatgtgttctgactgctccggtgaccagccattcccccaatttcctcccttctgtagggcctctctattccctgagacacaagagaattgaaattatgctaactaataatcctaaaatggcctctatgtgatcaggtaaaaggagaattgcatgtctctcacttaaaatcaaaagatagaaatgattaaacttagtgaggaaaacatgtcaaaagccaagatagaccaaatctaggttttgtgtgccaaacagccaagctgtgaatgcaaaggagaacttcttgaaggaaattaaaagtgctactccaatgaacacacaaatgataggaaagcaaagcagcattattgctgacatgagtaaaatttgagtggtttggatagaagatcaaaccacccacaacataccctaaagtaggagcaagcccctcttttcaattctatgaaggctgagagaggtgacaaagctgaagaagaaaggttggaaggtagcagaattggttcattgggtttaagaaaagaagccatctctatgacatagaagtgccaagtgaagtagcaagttctgatggagaagttatccaggagatctaactaaaatcattgatgaaggtggcacactaaacaccaaattttcaatgttggtaaaacagccttctgttggaagaagatgccatccagggctttcatagctaaagagaagaagtcagtgcctggtttcaaagcttcaaaggacaggctgactctcttgtttggggttaatgcagctggtaactttaagttgagaccaatgatcatttaccattccaaaacttctagggcccttaataattgtgctaaatttactctgtctgtgctctagaaatgaaacaacacagcctggatggtaacacatctgtttacagcatggtttactgaatattttcagtccactgttgggacctacagctcagaaaaataaaagaaattcctttcaaaatattactgcttattgacagtgcatctagtcacctaagagctcttacggggatgtacaaggagatgaatgtcgttttcatgcctgccaacataacatccctcctgaagtccatgggtcaaggagtagttttgacttacaagtcatattatttaagaaatacattgtgtaagactgtagctgccatagtagtgattcctataatgaatctcagcaaaggaagttgaaaaccttctagaaaggattcatcaatctagatgccattaagaacatttatgattcatgggaggaggtcaaaatatccacatttacaggagttgggaagaagttgattccaaccttcatggataactttgaggtgttcaagaatccagtaaaggaagtcacggtaggtgtacgggaaatagcaagagaattacaatgagaagttaagcttgaagatggaagtgaattgctgcaatctcatgatcaaacttgaataaatgagcagttgcttctcatgaatgagcaaacaaagtggtttcttgaaacagaatctactgctggtatagatgctgtgaacaacgttgaaatgacaacaaaggatttagaatacttcataaatgtagttgacaaagcagtggtagaggttcagaggatggcatccaatgtggaaagaagttctactgtgggtaaaatgctgtcaaacagcatgttctcgcatgtacagagaaatctttcatgaaagaagcaatcgatgttgcaaacttcattgttttaaaatacttccacagtcactccaaacttcagcaaccaccaccctggtcagcagccgtcaacatcagaggcacggccctccacttacaaaaacattagaacttgctgaaagcttggatgatcagtagcactttttagcaataaggtatttttaaattaagatatcaatgtcattgtttagacataatgacagtgcacacttaatagactatagtgtagtgaaaacatatcttttatattcactgggaaaccagaaatcatgtgacctgctttattgtgatatttactttattgcagtggtctggaaccaaattcatctgattttgacaccgactatggttcagagaatatctgagcagggacagccttccaggaggtaaagaacataatgatgtttctggaacttcatacaaagaagcagactactttcatgtgatcacctggctcccagtgcactccagagtttcaaggcatactgttctccttgtctacaacagtgtgtgattctaactagatgggccaccactctgtatctcacagctgtgtagtacatggttgagtttgtaggtgtgaagaaggtaaacgtcaacaatttggcccctgaaaatgaggacactggctcagggctgaggattctgactttctactcagcaatgtattatcatcgctagtcaacgtgaaccacattaagagagagcctattaaaagcctttcccacttttccccaaccccacagtccttcattactacttcccacctgcctgaaattgagaacatctaactcacaatccacccacaaacactttctccaccttccatcccatcttagaataagaacccttttccttttcattgtgaacagctccacttgtactctattttcattttttctctagaaatgtgctccataagatatccctaccatgacttccattctcttttgaacgttcaacctctccctgtctgcctggcctttcctctctgtcttaaatctaacacaatcccaaatcctgatactccactgaactgctcttctccctcatttttttttcacttcaatgacaaactccttaaaatagtttacttttctagtcttttcctatatctctttaccagatccagcctttcctcttctttcagctacttgcagcaaaataatgttccccagagtagctacatgtaactttagaagcattgaaaatgtatgcattctttgccaaagccttttctaaaccaaggaatgagttattcagcacacacacacacaccacacagcaacacgtcctaaatacactttggacctctcaccttacccacagagtttctgctgtccatggcagatcttcccaatctcctctttcttgaaaattattccaaaatgttctctccctaccccacaccagttctctatcttcagataaacatactatggaagatgatctattattctcattcgtctgagccagggcaatgcaaacaaagacacaccttctcaaagaaggtccaatatactagggtccacaggggttcctgtattcacagctaaaaatataccaccactccattccactctggcccctggtcattttcttctgtttcttctgttttttctttgttatgcccctaaggatgggatggcctagcacatgggactttgtccatcaagctctcttctaatgaacctgacaccaggaaatgtgttctcaggaagaagcaaagcatcaaaattcaatccatcaacagacaaatggacaaagaaaatgtggtatcaacacacaagagaatactatgcagcctttaaaaagaaggaaatcctgtcatttccttctttttaaaggctgcatattttaaaacctgggaggatactaagccaggcacagaaataaatactgcatgatttcattttcacatggaatctaaaaaagttgagctcataaaaacaaagtagaatgtttgataccagaggcctggggactgggaggaggagagatgttggtcaaaagggacagagttatacttagaaaggaaaaataagatttagagctctattacacagcatagtgaccatagttaatgatagcataatgtatagttcaaaactgcttttaaaaaagtagactttacatgctttcacaacaaaacaaatgaaaaataggtgaagtgatgaatatgttaataagtttaatttcatctttctacaatgtgtacatatattaaaacataacattataccctataaatatatgcaattattatttgtcaatttaattaattaacttctaaaaattcaatccaactgcctttatagcctttgctcaaacttgctatttgattttgttctctgcaaactgccatggaggccctgttctcttagtctattctggaagccctcatatatatcactcttggctataaattgctcttacatgaactaatccatctacttttgaatcttcaaaatgatccccattatgtcttcaagaaaccccactgcataaaatgctttcctccttccagttgataagtgcttataaatctggcatatgattcgatgactttgaaccaagtctcctactctttcaacagttgctcaatattccgtcattgaaatagaggactttgtggctttgcatctatacataatgttagatgctgtttctcttacttaatccccatcaccctcacttctcaggagcatgatggtgatgtatggttgtatggtagacacagaaataataagatttagtatttaatgcatacctactcttagtcataactttaaaaatatttcatttaatcctcataataatcctgccttgtagatattattgccagtttacagatgaagaaagtgagttttagaagttgaagaaacccgattagttatcagagtcagatttaaactcaaatctacctgactcaagtacttttgacaaagataagttgcactaatgttcatgttactaattaacacctaatgaacaatgtataattcaaaaatgacacaaattttgtgagaaaatataattattcactcatttaatttttcactctgctttaagcctccctaattctaaaagtagaaaaatcagccaagtacagattacctatatttagctgtaatatagaaaaagaaaaaagttgcaatgaaattcaacactgagaaaaatgtttcttaatctaattaaggctatttaaaagaaaaagaaaactaaagaaagcaacctactgagcttagaagcattcctattaaagttggaaacaagacaaattaccaactatcaccacttctactcaacattgtcctacgagcccttgccaataaaacaagagaaataagagttaaaacaattagaaaacaaattaaaaagggcttctttgctcttcaatatggatgcagaaagtccaaaagaataaacaaacaaaacaatactgggagaattcagcactactgcaggacgcaaaaccagtgtactaaaatcagtgtactcttacatagcagtaataatcaactagaaaacagtaggaaaaaagttatcatttgtgatacctgtggagctacaaagtaattaggaagaaatctaacagaatattttaaaaatatttctaatatagtaaattaccaaaccaaaaaatcttaaatatcataaaaatgtaagctgcagcctagttaatctctaaattcaatgcaatgtcaatgaaaatctccacaatgatattgatatggaaaaacaaagacaacttttagtgaaaaaacaaggtgaggagcagaccttgtctttatagctgactaaaaactataataattatggcagtgtggtggtaggtcagagttttgttttttttttccaaatagacaagtgaaagagactagaaagccaaaatacagatacattaatacatacaaacttgatacacggcaggaataaaatgatctgttcagcaaaagaagcgaggataactgcttatttatacaggaaaaaactggatcctcatatacaaaaataaattaaacttaaaatttttgaaagaaaatatggaaggaaatcttagtgaaaagagaaaccacagatttggagaatacatttataaatcatttaatcaaggaaaattaacatccagaatatatgtaaaactcctacaaatgacagactctttcttagaccaaatttcagttaggctcctctgaggtctcttctcaaccagaccttcgacttctgtgtccatttttgcagaattcagtcatagcaagaatcctgccaagtcagtttagcaagaatcccctcatcctttatatatgatcactcttaatatctgatcaaattcctcattccctctgactcagggaaaaatcaaataattatttttaaaaaattcttcattctccaccatccccaaagtgatatataatcaccctggcctgccttcagcaagaattccattaaattggtttagtaggaatccccctacccttgatgttttctcttaagaatattccatgcattcttcccctctctctgctaattggctataaatgccaacctgtctttactttatttagagttgaacccaatctctctccgctgttgccatagaagcaacccttattgcaacagtcttgaatacactcttccttactgttttaacaagtgtcagaatagttttttctttaacacaaatcattaagaaaaaaaaactcaactaaaaatgtgcaaaacagatgaataggaaacataaaagtaaacttatgaccaaaacgcatatgaaaagatgctcaactgcactataatcagaaagacaaatcagaaaaagataccacttcagacttattaaattggcaataatctttttaagtctgaaatttccaagtattgctaaagacaaagagaaaacaggaattattttttgctgttcatgagaaggtaaacaaacataagaggctggaaagcattttgttgttattcagcaaaattaaatgtgtgcatactccatgacccatttttacacatctatttattagataataatatatatgtatatgatacatattaatatataatataaaactttatatatgtgtttatatgtgtatatatgtaaatatatatattatatatatgtatataaaaaactattcacagagggaaaagaaaaacctaaaagtctacagattatctccagaactcaaaacttcataacattggaattgtgtttgcatggacctgaaagcacattccaaaggattaaaattataaactccacaaaaatgctgactatttaaatgtttatcacacaattaatgagaatgttatcttttcatatggatatcaaagtagtccatgactgacacccataagaaactgactgttctccaaacagagtaaatagtacagatttttgtacctttaaaagcacattcatacctaatcttatttgattatactagctgacctaagagttggcaatatcaacattttgtttgtttgtttaagatagggtctcactgttgcccaggctggtcttcaactcctggactctggtcttcagctcctggactcaagtgatccacctgccttggcctctcaaagtgctggaattacaggcatgagccaacagtgcctggcccaatgtttgttttattttttaatgaactttctgtgtaaatgttgatgccaccagcctccacaagaatggaatatactagctggccaaatgattagctaacataaggaaccagaacagataaccctagatccctcctgacattagctatcaaataaaatgcttttgtcaaatttacataacttggacaagcttttatctggggaaaagcaagtagttcttaatgtagtgttttccttccttggcaagtggctctagctggtatttcaaggctctaacagagaatcggtggtgcaaagcctgataaatcgtcatttgaatagcaaattatattggactttaagattctcttccattaagagagagtaaatgttccaaattctcttaatttatctgacaggtcaaaggcaggcttgtgggcatttatattcagaaggttgtctttattactaaattacctatgagcttttaaagtccagctttactttctagaaaatctactcaaattttaaggtagataagaaaaatgagaaagaatggaattctgtatattttaccttctcattttgttaccctaacctagaaggaacatatacaaatagattcaaacagctatgtggtttattacaagaagtcatctttttaagtgatgatctttacataattaagcatatggatttagaagctattcccaaaggtgcaaaagatgaagtgatgcgacttgatgactatgataaaaactaagaaaagacaaaaatggtaaatggaagagggagggagatgtatatttatcacaagtgtacaatgtattagacacaatgttgcatagttgacccataagaaattatttcactttcacaaaaatcagtaaattaagaatctttgctcctcatttaacagatgagcaaaggctcaaaggtgttaattattttttcccaaatcaaacaacatattttaatcctaagatgcaaacaatggcctgtgtaattccaaagcctatgcttctcttccacatccaactgccttgcaagaaaaggagactcagaagaagcaccaggaaagtattacagcagctaaaatggtgacagagcaaggatggtatcatgttaccaagaccacctcataagtaactcaacagggaggggaggggctccagcgaaaaacctgcctttatatttctagcatttagcccacaataggtactcacttacgtgttaaactataggaatggctcaggaagaaagagtgaatgaggattaggaacatagcttgtggcccacgcctgtagtcctaattactctgaaggcggagtgggagcattgcttgagcccaggtgtctgaggttacaatgaccctgtctcaaaaaaaatgaataatttaatttaattttaaaaagaggaatatcacatgctgcctagaacaaccacttacattattctaaaaatgttcagagaataggtagtgagtttagaaactgtacatgattaagcatgtacggagatgatgaggaaggctggttaacaaatggaaacaataggcagcgtagtgtaaggtaagttaaccaaacagaccaggaaacaggattcctgcacttcaatcctaatgtggtacctgtgtgaccttgggtaagttccttaccttctctgtacatcagtttccaaatctgcaagatggaaataataatcgtacttgcctcacagggttgttactgtgaagattaaacgagttaatatatgtaaagcatttaagaatatgtctaacatatatagtcttatttcagaattagccaatctttagaaaagttggacagttgtgggaaagaaggtttgagaaaacttgggagtagcagattgaggaaaaaaataacaccttgaggtagaaaagatggaacttgtttgtagacacgggaaaaggagagattcaggaaagataaatgaaaacaggccagatgtggtggctcacacctgtaatcccaatactttgggaggctaaggcagtaagatcacttgagacctggagttcaagatcagcctgggcaacatagcaagaccccatttctacacaaaaaaaatttagttagccaggcatggtggcatgtgcctgcagtctcagctacttgggaggctgaggtgggaggatcccttgaggctaaggagtttgagatttcagtgagctctgattaagccctgcactccagcctgggttatggagtgagaccctgtcctaaaacaacaaaacaaaacaaaactggaagaggccacaggaaagatgagaatatttagaggaactggccttaaaaaggagaaaggacaccagttctggcacaaaggggacagtggagagaagatgaggacccagagtagtttttttaagaagtaacagaagtaatgaggtgagacagcagagttcacacattccaaatcatcatctcagtctccttgttaaagtaagaaaataagaaataagaattttgtggagtaataaaaaaaaaactttagaacagtttttcatgaataaaagtatacttcatatcagtgaaagtaggctaaattcagtggattcaggtaccaattttcatgaccttagcaacacatagagtaaagccagataaaatgacctgtccagggcagggatgctctgagatagacccagtgagagagaaattccactaacagcaaagacaacccagaatttctcctcatgattggctatatcatctgcctctagttactgtttttatgtaagtaccagtcaatcaagatcagtggaaatcatttcttatgtcattttattatttgtatagttttctattttaattaattgttattataggggaaattaactaatttctgtttttaaatcttgtgatgttcaagaactatatgatttaaaatagtaaatggtcttttagtgaaatagtgcagaccagatatacatatttatctctagtccatcctgaaatgccctcttgaagctatgtccttataaaggaataaagacataaaactgcaaggacaggaggaaagagagacaacatgacagcattgagatttgtattttggaagatggaaagaggaaggcaagttctgactgacttcacaaagaaagtcaacaagaagcaaagtgatgcaggacccagaacctcaaaaaagttcagggattagaggcaccaagtacttctgaaggcagagggcaaagaccggaactaaacataagagaagtggctgcaagtctatttagggaacaagtagaacctcaagtccttcctcccaagccaatgtggcaaggcagccaccccaaatgatgactggagatctacccctggggaaagtgaactagagagaccctcaattcaaagacacaaagcaaactgaagacagttgggaagtacagtactaaagaaaggggtgttatgtcaaatattcttagtgccccagtccccttctcctcccactccacttcccaagtgatagccagtaatattctacccttcttcccaccgccaggcaagaatggagaaaaacacaccacccaaaagactggtagacaagccccatgcatatatgtacacacagaacttccagtcagttttttttgtatttcatacttaaaaaaaaaaaaagagtgctttccatttttctgtgcaaaatgtgtaatatttcagttatgttatggaagggtggaaagtttggaatctgtgaactctgctgtctcacctcatctgttacttcttgaaaactgctctgggtcctcatctcctctccactgtgccctatgtgccagcacttagaataatgccaagtatatgttaagtactggaaaaatacttgttgaatgaattatgtgtatttaaactctcatggaggcccaaccacctcaaaaatgttagcattctattcatagagtgtcacttcatatcagtcatcaacaaagaaaatctccctaacatctccacactttgcagctaaattctattttattgcacctcaactttacacataaaattcacaataatcaacttctaaaaatcactttatatttaatagtatctattcttaaatgaaagcacaggaaatttcataaaaagagagactgatgacagattgctggaggaacgagctccagggtccctctagtggccttgaagagctgacaccctccccaaagtaccaaacattcctcagcaatcaacatccaacaaacaccaaggctgtgtctgggctggggagccccacccggctgcagagatagtgaaatgactccacacttggctacacaggaacgtcgaagagaaaaacacaaagcatgtcacaaggtgacatgtgacacattacctagtaacaataactgaataactggggaaatagcatcttgtgcacccctctttttcctacatcttcctttttacccctctgtgacccccacttttccccaaaaagcatgcacgtgcccacacgcatgccacatagactgttgtgcctcacacttagtaggcctggagcaaaggtattaaggaactctcaaatcatttcgtctaaatatttaaaagttataatcaagctaactgttaaatgttaatatcttctattatttcactgtgataaatatgcttccatgaaaacaaaataaaaacatatgtgtaaaactatgatttttatatgactaaacacagataaaacaccagagacttctaaatttaaatattattgcttagctgagtattctgtaatgagccagaattgcttggatgaataataaagacattcctaagtcatacagtttaagtattctataacatgtctttgttctttctacatttcagcaagatcaaaaattatgcttttataatctagattttcacataatttacattctattgacagtaatgccaattagaccacctttcttaactcactgtaatttttagagagttccttattattttcaatttggaaaaactttgttgaagcagtgacagccgggattgtcaacaaaattcttaaatccatacttgtaactcaaattgaaccctgagttatattatcatgttcaatccttttaatggggtcacctaggttagattatttttataatataaaatattagaaagtattttaattttattattaaaatcactatcacttatattgtaatacttactctcttaaagcaatatccagacctacttatttcttaaatttcatttcttttgattttttgtgcaatgtaaacaaaactgaaaattgcagtctgttgctcaatttgtttaaatgtctatttatttgagactataccttcaaccaaaatagcgagaaaatagtccccataagaaattaacgtcaaaactattatctcaaggcctggtgcagggctgtcaccctggcacgcaccttctcttctttcttcagctgccttcttattcctggaagtgtatttccagaatcttagttccattattccctctcactagataggtagtttacctaggtttataattccacagttgttttcattcagaatattgaaggaattgtgccactgctctccagcattgatgtggggaagtccactaccattcagcttccaggtcccttgtgtgtgacctgtttgattattctcaaagtctttagcatattttcttccccgatatttgcatgactggttctttctcattatacaattccctactgacaccttgagggaccttttctgaacagtcaatcaaaagaagctcccacacatcactctcacatcaccatgctttagtttcatcaaggtaggttattactatatgatattttcttgttttgctcatttctatattttatgtttccattgaataaactgtaagctcctcaagaatttgcttctgaatttccagtgcctaggacaatgaacaggaactcaataaatgtttattgaataagtaaatgaaagcattactgtcataagtggaataaaaacagccttctgattttatttcaaaattatgtaaaacaggatcatgtcgagggcctcatctttgtcatggtgcttagatttactgcaaacatgtcttctgcccatagctaatcctaaatcaggagccttaaatctttaactaaaatataactttggagaagttaaacttatttgttaattatgatttaaaaaaataatttagcctctcacaaaagctgaaggctttgacagccatcctcctttctaaatataaatatgcctatcagctcattctgatactcaaggcacatttagcagctagtttatcctagtaggttcatcagaaggaactttcctgaaatcaggagaggtcacactgagtttctagtatggtcaaggaggtgatcagccctttaaatattttaaatctcaaactgtatctcttccgtgctttgtgttacaggacttgaggatcccaggggagaacttgttcaaggttggaccaggttcaaagctccttctctgtagaagtgtagccctgcctaaagttatcttgttaacgctggaaagatacaggaaaatcttccatcagagcaagaattcaagttaggctccaaatttcatggcagattatccctctgccatctggtatctaaagaattattaatcaatgtttaaattagcaatatagctgactggcacctcttgaatgacttgtcagagttcaaccacaatctcactataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccagcaaagtatataagaacacaggcttcggtataaggcagccttggtactaatccaagctttgccattaggaactgagcatctttgggtttgctatttaacctctctaagtcatactctcctaattacaacagcacttgccccctaggttattaggaagatcaaatgaagtaattcatctaacgttctaggcatagtccttgagcatttaatgaatgttaattgtaattattattgtaagaaattatatacttgaacatttccagattctttgcaaactcttggctgaaagcatcattcattacactgcaaaaaataatttcctcttagctgagtgctaacacagaactggctcttcaaatacacttgagattttccttaatcaggtggagagaagcatatgaccaatcatgttttctttccagaaggaaactcaggtatttgccataataatctcttccagattgctctattttttttgctttttttccccttaactggctttcctttttattttgtttttagctgttcacttttatatcatgtttaactatatagcttgtggatctgccattcactagctgagtaaacctggaggggttatttaacatctaaagttccactttcttcatctgtcaaatgagaattgttgtagacaccagtgatactatcttttcagcatccctttttgataaccactcctctactccatccacattcccttgataccattaaaggggcccagccctctaagcacttagattagtctagaagtgatcatctaattcaagctgaaccaggaagacacttgccagagattttggatttaggactgaaagagtcaggtcaatttccttctagtagctgaaattataagacaaacctcaggaactgctagtggctatgtatcccacttatggaaaagatagcctacagtgaaagaaaagaatgatactaagagacaggaaagagaaggagggagagtcctaggggttctaatgtttcctaggttcttgtttttcctgtagcttggctgttctattagtcatctagtatctttccagtaagttgtcctttgtgcatatataattttgtttgatttctatcacttgaaaccaatatagttctaatacataagaaataatccctacactgagtagttgttataaaaagtaaatgagatcaaataattaagtgctaagcatattacctggtatatgatacgtgctcaagaaattgtgcctattaatattatttagaagatgtggatataaatataaattataagtcagacaattaataaaaacaattttaataatttgcaaatcttcttgcaatttcaaaatcaatcaaaggattatttgattctggatcttcaaagaattgtaaaataaatgctctgaataaattttgctatataatattgtataaatgcaattgagagactctcatatagtaaataatcttagagaataatgaagtccagaacagtgatccacaatttctttcttaactcacttgtttagagtaaacatatacagggaaggtggaaaaacaatgcagacttacattccagttaccccacatatataggaataagtctgacatacataaatgtacaaaaactgacttagctgcataaacagtcatgtttacacagtataaagaatgcagtataatgaaggaaaaatggaattaacatatacctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctatatgggaacaaaaaccaaagagattataagaagaaaaaagatgattcatacagacaaggaaatagagtttactgctttttatttataagaggaaaattgtatgtctattctatgtgtaaagaagtatttttagatatataaaatttctcttttttacatgtattttcatttattagattctgctgttactgtttgttcgtgttagaacacgtatacactcttattttgatgaatatgaatagaatatgaattatgcacatctgttattcaatattaaattgctgatacttgaaaaaaaacaaaaataacctccaaattttacaacatgaatcaagtatttatcttatacttgtcaatatattgactctttgttctccttaaactcacaagcctaataactggaccattctcataattctaaaaataaaatttctgtctttatttgcctatataaagtagctttagggggtaaaatattggatgttttaaataaagtccatttacctgaccatatgtctttaataacatctttagcattctttcaaaaaagaaaagtaggtaaaatccaccaaacacagcaactgccttctcaacataactgtcgactttgggatcaaatccaaatgcctaagggagaaaaaagggcaattcaagtaaaaccaagaaatttaacttgatttctggaaaataataccagtatgcaattctcaccaatgttctaagtctctcttcacatccaagtaatattggaaacttagctgccaaaaatcacaaaacaaaaactttgaaatttgaatgacaaaactgtatgagatggcacaaaaaccttacaactagaagtctcattaaataaagccaccagagaatcttacagtttcccacctataacacctacagcaatatttgccttgaaagagtaaacttttagcagtaaagcagcagctctgattctcatctttagaatacgatattaggtctagataatgaagataaatgagatattgattacctactgtctctaaaagtaatatattagtccatgatatccagaatcaaacttttaaaacaaatatggcaggccacttggattactgttttcccaagagaaatcctcttatacctacagaactgtgataaatcctaaaaaggtaaataaatcaaggcctaggcccaagaataaaagcaaaaagaagatttaaaattgccaccactctctctctctctttcacacacacacagcaataagaatggaataattctttctttaaaggacaaagaactggagttagagtttgaagttataaagagtcaagatgttcctaacagacaagacacataaacttcaaataaatagaatcagaggagagactaatgggtgaaaagccacaactttacaccattccacacattgtaaatctcccctctgaagcagaatagaagatgtctgggttcttgtcctatgtttgcctctggggagacatcatggccgcatcctcatttgaataacttctttgtgcctgtttatacaatgcaaaatggctatataaatataaatgttccatttacctaacattgaggttatgaaaataaagtgaaataagaaaaggaaaatcattttgctacaaaaaactctatgaaaatttgagagattattacaaagacagattctttatattgttaaacttcaagaaaatagaaaaccttaacatcatcaatgtagagtctttagtccacatacagtattagtttgtttaatttactttgacccataaagcagatgagataataaatacatatattatatcatattaaatgtattatgtatataatactcttttaaatcagaaaatctgtattgtcatcctagctttgttactagctgattgtaaggctataatcaaattatttaaccaccctaaattttaatattttttatctctacaattgaggctgtgaaatagatattatcttaggtcctagatcaaataatgataataaatctataactctaaaaagttatatacccactttcaatgtatagcttgaaaaattaaaggaagctttagttataattttctaaaaattacgagataagggtggtactccctgaaatactattaatattttctctctgtatggggtttgtctctccctgtgtgtgtgcattgtgggtggcagatacagtccatgtatacatatatttctctagttcccctttgtggatcccttctatgaaagtctctttctcctttccttcctcttcaacattgcctctcttttcctttcatttatttcccttcctccatttctcttccttatatgggcacaacacagatttgaaataaattgaatagtgtgcactatagtcaagatagatcaataacacattttatcaaagaaaaaaaataagttgctatttatttattagtcctcaattgatattttttccacagttggaaaaaatgaaaaggtttgtcaaccatgctctcatttactctctagtcacttataactgtagtaaatatatgagggaatttagtggtatatgttaaatacattataaatttacatttgacatttgcagtacagttgacattgcatgctctttagaaaaataaataaataaataaataatgaaacagtgtgtggaaaaattaaatttgccaagtgcaaggcagaataaagttttaaggccttctgaggtgtcccagagctgtctgagcacgtcctagtggctggcctcctagaatattaattttgtctctgatagtgatatccactgcagcttgggacaagcctttacaattgctgtgattcagctttctcttatccaagacactataaactagaccataaaacgctgtaagaattatggaggctaaaaacatacaaagtgctaaaacgttcaaaagaaacaattattcacagaaacaaatagccaacatccttacctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaactgtgggtcagagggaaaagagagtagaaattaatcagagcaaggaaccaaatgatgttttcctgtacattaagcttaaaagtgtctttaaaagcttaagacacatatcttctttaaaagaacaaaatctactcaatgaaaagtatatagaaaactgagaatacaaatatggcatagcaagcattaatagtaatactgtttatgttttaatcagccctaaatcatcattatgggattaatgagttttacagcttgcagggaaattggagaacatctagaacagcgaacagcgacaaacaatctgagatccacaggctccaagccacctagtttcatctatggctcaaggaatagattaaaacagcattttgaaaaaaaagaaaaaacaggggcagtgtgagcctcaggacaaaggtatggggtgatgggtgggagggcagggatggagatgggtcacagtgagctagcttcaaggtgaccatagctgctaacactgagtttgtcacaatcatttgtcttcagactcctgaggacagcatctcctcagagaaggtggcaccagcagcacctcaggtccccagctggagcctcctgggaatcaaagtcagtctgatgcaataagcactcaggaagtgagcacatggggcaggagggagcagctgcattacataacccaccctgtgagacacaaattaggcaaaaatattccatacagaagagatgctggtgacagaaaaaggtggtgcatctttcatctctggagacccagggcctggcacccagtaggcacacaataagtattgcttagaataaaatgaatgaatactatcctaagctctatagctaatggcatgtgtgacctattgcctttgggcctcaatttccctctctctatcttaaaggggctggtgtaaggacaaaatgggaacacaagtgaaacatacccaggacagtcacctatgtgtgggtgcaggctgagatacaacgtggcctcagggctgtgcaacatgtgactttgcctctggccccacacactgtacacaaagtacagtgtgacagaggagaaagctgcctctgcatagccacttctttaaaatatccagaaagcatgtttaaatggtgggccacttttctccatggcactgtcagtggagtacactagtaacacctacagctcagggagcatttgccatgtgccaggccctgtgctaagtgatcaacatatgtcaacttatttgaacctcacaaaaccctgtaagagaaatactactacctccttcatacagttggggaaaccaaagcagatggaattcaagtaacctgccagaatcacgcagatagaaagctggattttgaacctggacagtctggctcccaggcccacattttttagcatatgctttattattcctttagagataatctcatttttcaaaagcccaaaggactcaataaaactgtaaaaatgttttcctgaattatacatactttattaacacgagattgttcactataattattgttagtctagaatttctatgtacaaataaacaaacttagtaaatgttcattcagcctagatgacgtggaccaaaccatggctcctgccaccacacacacacaaacacacacaagtgcaaacacacacacagagtgatacaaagtcacctgtgctaagtaccaaatgaaaaggtcagattataaatggtactatgtaaccccgagaatcatcacagcactgaccatgacgactgcatcttctccagacactttcctatcagttgcaggtcctggccatgccctacaacttcacctaacagcccacttcattcccatttattaccttatcaccttaaacaatactactagtccccacagacattccacttggagagagttctcaattccacaccttttatcgtggtagatctacatggaatttctcttaacacaaacatacttctatccatcactagcctacatgccttcattcattcaacaaatatttataatctcattgggtagacaagatatatacatgttgaaaactaaaattaaaaggcaaagaaattgttaagtgccaatagaagcaaagccacatgcacatgttaaactcatcagcttccctgcaaacacctgttccattacccttgttcactacctacataaataacaggaacagtaggatcaatttcagtttttcactttccaccaattaattccatagacaactggtgatcaaaccctaccagttctgcttcaggcatctctcacctctagcctctccatcctcattgccagtggtcttgaagtcagaccctcatcacctctcactccctcatcttatataacatgacagttatcgatctggtgcccctcctactagctgacatggcctacagacttatactaaatcacaaaagtgatcatctcatgcccccatttgaaatcgcccctcataaactgacccttgcacagcctctccagtgttatttacccccttctcaacatggcctttacccaaacactatgttttcccaaccgagctttacctttacactgtggttctctgtctgaaaacactttcctatcttccttgcctaagaaagtcatacgtggccttccaagccaacacaaagatctcctctatgaagcttccctgctctccaggcagtactccctggctggtcaggattcccattactctttgttcacttaccacttcttgtgtgctacagtaattttatcactgatatatttgcctacatcatataaactgtgtgattctcaatgagaagggctatgttttattcatcctcagtgcctagaaaattgtccacgaaaaagcacacattccttgctgaatgaattgataaattccccatttcaaggtgcagcagaactctgtcaaaaagaaataccaatcgatctgcttatccaactttctaactttctttgcccttgcacatttatcagcacaacttgggggatggtgggagtgtaattcatcacattctaagcacactgcatagcttccccttcttgtattgttagaacatcattcagaaaaaaatgtctggagtttccattcaactgaagcactttccacttaactgaagcaccaaaagtatacattagtatgaatctattccttggacatctccatatatacgtgggactttctcaaacgatctgtttcagagagggaccagtctccttataagtgaaccctgaaagattttaatagatttcaaagaaatacagtcaggatagtttacatttattgactgtccactgtgtaagattcttctaagaactttacctattttaactcatttaattctcacaacaaccctatgagataggtgctgctatttttcccattttaatagtgaggaaatatggttctattatgatacccattttgcagacctgcatacagcccaggcttcaatttttgcctggccccatttaactgtgaaactgtatagaatggtgtttaacagtgtgaactctggagccagaggatttgtgttcaaatcccagctcatcccctcactggcatcataggttggttccttgacttccctaagtttcagttttctcatatttaaaatgcagattaaaatagctcctatttcatagagttattacaagaataaaataaaaccagttaatgctgtccctggaatatagcaagcctttaataaatgttgattacaattatgtttaaaaaattagtaagtagaccatgatataaatgttagttcatttaattcactgttactcagtgaaaagaagaacaaactaagaatcaggagctctcatttcaccttaggtacgacacctacaagaagccacttaacctctctggaacttggacttacatcactagttgtattacagagttggacaatatgatctccaaggatgcttcaattaatattctttattttatctactatatgaattaaatatgattctgcaacttcatcaaaaagtgaggcaatttcagaccattaaattattactaaaatgcaattaatttctctcctagagaatttaacttatcatcagtttactgtactcatcaatatcattttataaagcacatgaaatactttcaaaaataaaatgtgaggcctctgagaaattttactgtctacccactgaaatgtcaacataaatgtattcaaatttttgtatcatttggattgtttttatgttgattttttattgctttggatgagctaaagacttgactcttcattaagtgaaaagttatatgaaaaatccagtgcatttaattattttaaaatgtttttcttagtgagaaaaacaataggataacacaggggccagggaatgtggtgaacctatgaacacatgtataagaacaaagacattcttcttcctctgtgccaggcattgttctaggcacttacgtatattaactcatttgatactcccaacaattctataaaggtactattaaagtaactgacccatagagatattaaataatcatacagctgcactaaaataaaacaatcaagatatcacatcaaaaaggcaatagagtgccaagttaaacatcttagatgagtagtaacaagcactctactagtttccctaaattcccctggaaacatttccatatcttctccccccgatcccactccactccagcctcatttcaattcctaagacaatatgcaccctaagaggcatttctctttttattgggttatctgtctgaatatttggtgatcccataacttagaattgctgacttttccattttatgactttgtagtgttgtccctagaattctacctctcacaccctgcttctgacttcccagttctcaactcctggttcctgaaacagagtaacctagtcaactggggtttaaaaattacttttgaatatgagtaattaacttgcacagagcaactggggttaaaaaattacttttgaatataagtaagtaacctgcacagagtagagtatttgctttttctgaaacctcacttcctgtacctagagttatgcacgttagatgtagttatttaacagacctaactaacaggcctaccacagcacctaggtactgaataatgttcgaagtactttacaaatattaagtcatttaatctttacagcaagcccataagaaaggtactattttagatgaggaagctgaggcaggaaaaggttaaagtcatgttctcaacatagctggaaaattacagagctgggatttgagcccaggtaaactggcttcagagtctgtgcttttactgtgcaatactattagtcaagggtagtatcctaaagcgtttgctgaatttactttttaatgtaaagtgcaaactgtattaaacaggcttgtagaaatataaatatactctagcaaaaatatttgcttgaacaattagcaattcaaaattactaatatttcaaaattgaaattactgttattcacaaaattgcaaattatattgataaatgatacttggtgatttctatgctttgtatatataaatacagaatatcaatgagaacatgggttctgaagccaagacaacctgggctgaatctggctctaccacatgcaagttgtgtaactttgagcaaatgactttaaactccctgtacctttgttttcttggctgtaaaatgggaatagtagtgtctacatcatatagttgcatgaaattaatatatgaatatgtaaagtacttcaaagagtgcctgtcatatagtaagtaccacaaaagaattggctatcatcattgttatttttgtcattgttgttgttatttcttttattcatatagagggagactgaagtgtacatgcacaaaggaatccggaaatgaaaacaggcactttctttgttaagtcttcccttttcttctctatctttactctctttatctatctatactcctgtcagatgagctcactcagaacagcatctttatttttatttttttgagatgaggtctccctctgccacccaggctggagtacagtggggtaatcataggtcactgcagccttgacctcctatgttcaagtgatcctcctgcctcagcctcccaagtagctaggcctacaggtgcatgccaccatgtcagctaattcttttaacttttgttgtgatggggtctcactatgtttcccaggctggtgttgaactcctggcctcaagcaatcctctgccttggcctcccaaagtgctgggattacagggatgagtcaccgtgcctagccccagtgtctttaaatatcatctctagactggcaaatccccagtcttgacctctcctctgaaagcaatctcctctccaaatgtctgtgtgcctttgcctactggacctccctgtctacctgtgtatgtcaatgtctcaaagcaaccacgccaaaaattatattctttatcctcaccactcccttcctctacaataaagggctcttcccagtcttctccatcccgggaaatggtataacgatctctccggtttctctggctcaagacttgactcattgttccctctcccacaatcaatccagggcaaaccatttagcatgatctccaggactcatcccgaatctactgcttctccccacttctacttcccccactttagtccaagtccccatcatcctggcatcagctcctggcaatcgcttcctgaccaatcaccctgcttctactcttgccccattacaatctgttcttcagattgtaggcaggtggaatgcccttttaacagatttgaatgagatcacagcattcccctgtttagaatggtacagtgacttcacactacattcagaataaaacccaatcaatttaccacctcccgcaaggcttcctcacctggtctccatctcccgccaggacatatatccttctaccttccccaccaactcactaggctccagacacataggagcctcttgctgctcctcactcatgccaagctcattgccaagctatgttggctgtgccctcaatcaagaatgctcttcactagagacgaccttgctgtggccctctccttctgctcagatgatacctcatcagagagggcttccttgatctatctaagatgacactcacccactatcaccttctatccctcacctactaatattttattttcttcatagcacctttcactctgaaactatgttgtttatttgcttgtttaaatttgcttgtttaaatcttctccactacactgtaagccctaaaaagacagataattattcttcttgtttaccattgactccttagtgcacagaacaatacttggtatgtcgttcaataaatatttgcttaatgaacaaatgaacgaaactttaaaattccaacataattttcaaacagactccctgaacaattggtttatctcattggtgaaagtgacccttctacacatttaagcatgtgagctgtatattaagcatacatatattttattatggtttaaaatttctttgcatcagatcataccgttaaagtacatattcatggaaataccattatagtcacttaaaatagtctctggtattttctttcacctatgaaaattaaaactaataatttggtccctgaaaatttaatctagaagcatgctagttctcttatctcttcattggtaactgcagataaactgacaagctttaaaataatatggtaagcaaaagataatggaaatgaaatgatcaattataagccaaagaaaatgcaatccaatatgcacagcataaaatatatattgtttaaaatcaagaactggattttataaagtttttaagtgtactaaatgtaattttgattcaacaaagagaagagcataacttatgaagcttaaatgagttataattcttcttattccaaatactttcaaaatataagtattattcgaagaagttctatgtagattaattaaaagcaataaagcagaaaaagaggcatattaacttcatttcacaatggttcatagacttttcaaataaaagagaaaaaatgcttctaatataccttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactgaaatagaataaacaaaaaaaaaatgtgataataatgtgtaaaagcacataagcaaagatgctataaagagacacagactatttcatctagatgcacagcactctttatacaaaagcccaccacagaaattgaaaggcccctaaagttgtaaaacagcccacaccagtttaaacctagaaacaagaaaaatagaaaaaaaaaaatcccttcttaatcaacagctttcctacagcagaaaataaataagaattggtttgggcatatctaaggactttatttaaaataggggtgcaccaacaccattcaaacaaagggttttaaaacaattttttattgtcagtaccccctcttagtttacttttcttcagtttgaatggatattttgtgtgtgtcactggcatggctctctatagcatttcttgtagacaaatacctggctccctacagtttcatgctaagaaattcctctcttctctacactgcaataaatataaatataaaaagttgttttaaaatatgtcttttgcacaaactgtttttcattaaaatatgcattattctcaatgacgttgggtaacttttctatattaagttttgaaaatagtgctgggctgtttagaaattcattaactattaacaaggactagaatctacattaggaaaaaaactgcaaaaataattttttaaaggtataatgttgttctcacattttaactgtaagctcttccatatacagtacttgcattattaagaaaaatataaaataaatgctactgaatgtcataagaattatagtgtgaaaaatatccattcactcaaatggaagagtctgtctttaataaacgtaatttaggcaagttatttgcatgcttcagccaatgcttaaaccccaataagaccttagctatgtactatgatctgaattatgtctccccagattcacatgttgaagccctaatccccagtgtgatggtatttggagatggggcctttgagaggtaattaagtttagatgagttcatgaagttggggccctggtccagtgggattagtgcacttataaaaagagacatcaaagagcctgctcacttgctctttctctgctatatgaggaagcgagaaaatgctctctgtgacccaaggagagagccctcacagacagcaaccattctggcaccttggtctggacttcaagtctccaactatgagaaaataaatttctgttgcttaagccacctaggctttggtattttgttatggcagcctgagctgactaatacactatgaatggtatcaataactcaaagttgatgttaattgtttgaccataagatgctgtaattccctttactacagaaacaatgaaatttaaaatgtcatattttgttacaaggagatcactactgtttataaaggaaaaatgaaaaaacatcaaataatcaaatacaccaagatctatgcagttgtccaacgctaagattacaactaccttacagaaaatgcacatttagatttttttaatgtctaagtatgtacctaaaattgttccttattcaacccactgttttgagtttatgattaatgatagctgcatgccatccatagaagaggatacaccacactcaatgccctgttaacagtcttccctttagctcagaatgatgtataataaactaatggagggagaaaatacctcaagatttaattggggaagggaaagtgtgaacagtttattcatcaccaggaaggcatccagaagcataattgctagattcaaaaagtagacagcccttgtggttcaactggacactgtgtgcttccaggaataaataggtgtgatagcacatgatagcacacacagagagcaccactgtttccctgcaaggaagacttaccctacttggactttaaattcctccaactgtaaaataggaggaaaacgggaagatgcctatagataatctccaaagacttttcagaattagcatgctaaggctccctaatacctgatgactgttaagcagttctttttcagactcaaattgtaacccattcctgaatcaggacgcccacttgctaaggcacagtctgcattttttaatgaagtaaaatacaaaataatagaaactatagaccatatcacacataatagggtaagtgttgcttaaccaaactttagttacacatcatatataacatgaacatgtatactggatcatgatgtaaaatgtatttcttgctgtgaatggcagtcacgagcttgaatgccaccacccttaaggatgtcagaattgccaactgtacatcattaaagacaccctcctacatacaattagaaaaaaagaaacagtgcagtcaaataaatatataattaataccatcagatagcttagctgtgcagcatttgtgttgaaattttagctggacaggtggtcagggatagtcacggtagtcatggagagtggcaactgtccaatcaccacgaagaacacagagatgtagagatgataaaactcaaagctcccctcatgataagagaatgagaacagaatacgaacagtgcagcagaactgaattaatggcaagcctgacttatttaaaatagctatctaccagcaagtggaatgaacacaattttggacagtggcctatttctggcttcaaacaatcttgatatttattatactttgacttaacaaagttgaaccagaaacaaaagaaagcagttgtcttagaaagggtggtgcctcccagagtgggaacaaacaggatgagagtccagcgcctgaagagtgagggcaacaaaaccaaccggttataccatggacaaggaggctcaaacaccctcacaagcacaccctttcacctccaaaacaatgaacaaacaaattacggaaagggtaggatcatcaagtgctactcagaaaactattcaggatgattgtacggaatgctatctgccttaataaaactccatgtgctttcgccagctccttcacatttatgacagctttacttcttttcatgcttgtatctatgacactgctgttctcaagcatgctgccctgatgtttgctgtggccttttaaggtttcagatgtcctcgtgttcagcgcgttgacatttttcataaagactctaagtttgaagttaagctcctattcactggtctcttgccacattagggtgacctcaaatgggccttgtatgtgtgaaacaccaaagtaaggtagcattataggtaggggctaggtatatattacaaaagagaccgcaaagtatgctcaaaaccgtttcagcaaatagttatgtgcattttggcttccgcttctgctcttccttcttcctcaccagtttttatgagtcagaagtttttctgcctctttcctaaacatgtccttatgggaaagtggggggctggttcagagagaggatgaaggaagctcaaggaattagggcaagttccttccttagcattttacacaattgagatctggttataataaatgctgaatctgaaagcttcaatactgacaaagattctctccttgactaaactgcagtcaggctcctctgagcccaggcctcgaccctagcatccatccttacaggacctgcatcacctggtgttagcaagaaaccttctaactcagtttaaagagagttccctcaccctccatgtctgaccaccctggtcctgccttcagcaagaatcctgttaggtctgtttaaccaaaatcccccctacccttaatgtttcctcttagtaattttccattcactgaccccctccccactcctacccctgctcctccttggctgtaaatccctacttgtccatgttgtatttggagttgagccaagttccatactgaggtctcttttccccttgtgatcattaattttgtgtcaatttgactggccactggcttcccaaattaaacattatttctagggcgttaaacattacttctgaggtgtctgcagggtggttccagatgagattagcatttgaatcggtggactccgttaagtagattgccctccccagtgtgagtccaacccattgaaggtctgaacagaacaaaaggcagaggaaggaatttgtcccttttttccttcctcactgcttgaactgggtcatttgatttcagtttcttcaaccctccctctagagtttacaccactggctcctctggttctcgggctttcagacacaggctaaattaaagcattggctttcccaatctgtagcctgcagacagcagatcctgggacttctcagcctccacaatcacatgagccaattcctcataatctctcatatatatatacatatatatatatatatatatatgtatatatatatgtatatatatatgtatatatgtatgagtatatatatatgagaatatatatatgagtatatatatgagaatattatatatgagtatatatatgagaatatatatatgagtatatatatatgagaatgtatatatgagtatatatatatgagaatatatatatgagtatatatatatgagaatatatatatgagtatatatatatgagaatatatatatgagaatatatatatatgagaatatatatatgagagtatatatacatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagaaaaaatatatatatatatatcctgttggttttgtttctctggagaactctaacatacccctattgcaatgtttcctgaatgaaatctgtttttaccacttcgactgctgttaggcactggttttttaacaatatcaagtatagtagccatgtagttatactacagattgcattaactccttcctttattctacaaatatttatcaaaccataaaagtctaggtataatattgatgggagaagtagaaagtggggaaagctggaggatgacaaccaggaaggaaatagtacaaagataaataagtaaaactgccttccatcagcaaacttaaatcactgtggcagaaataaattagatacatgaaggtctataaaaccagagaggaaattataaattcacaaaaaacataataataaagaactatgagagttcacatgagggagaaatgatatgcagaggaaatagtcaaaaacaacattgacgatagaatgctgggagagtagaaagaggatgctgctactgctgttgatagatgcaggaggcagataaaagggagggtcctcggagaatctctacctgcctgagcagtgggagaataggatggagccatgggaatttcccgtgcgtgcaaggggcaggagcctgccctcttcagttcctgtgtttgtgacctggaaccaatctgtgagatgggggcctgttagcaggaactccgctagctttgctgagaggtcgtttttttcttttttccttttcgcccaataaattccattctcctcacccttcaatgtgtctatgtgcctaattttttctggtcgtgtgacaagaacccagtataagctgaactaaggaacaaagttctgcaacactgtgattagggaacctaggaagagaagcccatttggcaggatggtggcaactttggttttagacatttcaagttgcaatgctcctgggaccccaaatgcaaatgattggtgagctttccctgagaaaggtagagaccagagacaaggatgtggcttcttctgcaatgaggtcatagctgagtgggagtagtggagctgatcaggagaatcagcatatagaaagaagaacaaaggcttgagaatgcatacacgatttgtgcaaaagcacgaaaaagagccagtatataagcccgagtgaattaagctcaaaacataagaaacaatccagaccagtcaaatttggtagatgtctgtggtttttgccttcctggaatgatgaaagacatgtaacccttgggtttttgtcccatcatctagtaacagacctccttactgccatgggaactgccttccatgtgattttggtaagcataggagcagtctggatcctataatcacctgtgctactgaaaaactctttctccactagtcctgctgtgagtctggggacatcttaaaccatttctgccgccatgtgaaagaaggctaactaagaagtggagaaagacagattttcaataccatcacaataccctggataagctgtacctaaagctgatgtgcaccctgactcttaagttatgtgggccaatgaattccctttcggcttaagctaattaaagttgattttttttcactcttacaaataaaagagtactgatggatacataaagtaattatttaaaagtcacttttaaaagctagtgaatgaatgctacatcataacctataggaaaacaaaaagataagcctttccactctttaaagcttccacacttcttcctgttctccacacacaggctgttttgtctgcttggttgtcttatcaagtggcacccattaaataatacaatacagtaagaccatctgatcctgtaccattataccaaggccttcacatcacaccagaaatgaaatatcatcccattcaaaagccaccccagaaatggtttcagattttgttttgcaatagattgagattctgtgggaggctgagtagctcacattcccaataaggaaagtgctaggtgtggttgtattctctctgtggaggtaaaggcagggagacacagatttttgtaatgcatttagactcaatgacaatcaactttaaataccattacaaagccccagagggagcaagcagcagaactggggttagaatccaagtctgaaagagctctgtctagcttcttttattttagtcacctctaccctgcgctgccctgccagtgattgctacagctgttgctattcagtaagaactacagctactttctgaaatttgccatgtatgcagctgtgatgaaagccatgaaacccatccttcccccaccccaagtaagtggcgatctcctgttctttaaagagatgcaacaagtaagaggtttaataagaatccacctataatcttcatctgttctgctcttatagaagcccattccacttctccttcattctcattcatttattcattaactgaacaggttgctcacaccttctctgagtcaggtattccagtaggtgttgagaataagacatggttttcatcttcaacaatctcatcattcagcatagaaaggagatacatataaaacagataagcaaataaaaatatgcacaacatatcatgtgattaaaggaatgaggtcagggaaggcttcctagaggaggagatacatgtgctaagtttgttattttgatgcatctgattcttggggaaataagacatgatacacaaaaaaattaatggagagatcagtaacgcaaatgagtatgcaattagttggtgaataaattttataagcaatagttatcataagagttctgggaagcatataaggactacagtaatagcaaaccataatatatgcttaacacgtataacctctttaatcaaccacttaaatagattttaggttaaatttggatgaagaaatcctgtctagaaaggtaaatttctaacggtacaagattaaacaatgtaaaagtgttaaagacagaattcagatatatgtgttctcatgccttttgacttgtaagccagtattctggctgctatgtcttggtccaacactgagaaggattcaatgaaagaatcattgagaccctggcagagaatgcactttgttgcccctaatagtgagttgaaacacacaattaaattaactgttaaaccatatttaggatcccactcagagacagacttcaaaaataaccctacaataagaaattacttaatggacacaatatgtattattcaggtgatggctacactaaaagcccagatttcaccactacccaatatattcatgtaacaaaactgcccttgtacttacatttatacaaataaaaaagtccggccagctgcagtggctcacacctgtaatcccagcactttgggaggccgaggcgggcagatcatgaggtcaagagatcaagaccatcctggccaacatggtgaaaccccgtctatactaaaaatataaaaattacctgagcgtgttggtgcatgcctgtaatcccagctactcggaaggctgaggcaggagaatcgcttgaacccagaaggcggaggctgcagtgagccgagatagtgccactacactccagcctggtgacaaaccaagactccggctcaagaaagaaaaaaaaaaatcctacagttcaaacatcagccaacttttctcaccagagtgagaattttaggtatacttcgctttctgcacttcatttcttttgctttttcataattttgtttagtttgcagctatgaacttaaaccatttttgcagttggctccaaaaatgctgtgaagacaagtgagagattcattcatttatttactcattcatacattcaacacatatttaccgagcactactgcatgccaggtacatagcaatattagtaatcatcttaataaatactaaagtagatatgaattccaggattccagaggtttctttcccattaaataatcattgggatacctaaaagtgttttgaatatggcaactggccaaagatcccaagagagcaattgaaatacatacatttaaaatggtagtttgaatttaacaattgggagaccacttctgacccttgaaacaagtgaaccgtcccattaatttatccttttagggctcactgaacaatggaattggtgacttacatgttccacactcacagcaggaacattcaaagcacgagtgactgaggaaattgcttccagatttgttcttcctgcaataatgaaactgcctcaattacaaggcactcaagtttcacttccaaatctccctgatatatacatacatacttatatatacatatatatatgtatacatatatacacacgctgaatctctctctccaccttctcttgaagttttcccctctttaaagtcctcttcaaagtttactcattattattctatcaagataaaagacagttttctaaggtttaagccaagaacactctataaaaataatctctaggtttaagaggtggccagtcaagtgaccccaactctgtttccccaagattaatttttccatttttcctcaggttttcttacacttcttactgaagtcactctggcactgatgccaccaacacacatgcactctcacatacatgcacactcacactcatatacacacacactcacatgcatacacatacatacacacacacttacgttcactctcaaaactctttttgaagggaagatgaagaacgcttttcctgaatatacaatttaaaggataaagatgccttgttttatgatgcactgctagggataaaaagattattatgaaacaatatatagagaatgctgctataaataaggataaatctgtgctccaaatgttaacagtgtttatctctgagtggtaaaattatgtgtggttttattttttttcctttctgcttctttatatctgccaaagtttttaacaatgtacttgtatttcagtttcttttaagaaaaataaaattaagtcatgttttgtttgtttaaaatctctttttccaggttcccctaaacaaaaggcaggctggaattcttagagattttactaaagaaaaagaaagaatgttgaaagctacaacaatctttttaaaagaggtttacaacattttctgtctttgtcatagtgatggacaagtttcccagccctaccccattccatattcagcttttcgaggtcttgtcttgaaaagagaaggtgttcttttagactcctaaaagtgtggtgtggtgtcagagcacagacacccaatctagatccttcgcttcccacccctgacatgtcttcagggggcagaggccaccctacttcccatcatctgctagggaatcccatgggcattatcccattttgccaagatcaaaagcctttgtttccttgatgtacaccaagggtttcccactcagtccttctgaggataaagtgtggagggcatgctgcttcttcaactcagggctggggagttgccacaagaaatgagtgcaccttggccgggtgcggtggctcacgcctgtaatcccagcactttgggaggccgaggcgggcagatcacaaggtcaggagatcgagaccatcctggctaacacggtgaaaccccgtctctactaaaactacaaaaaattagccaggcctcgtggcgggcgcctgtagtcccagctactcgggaggctgaggtctgagaatggggtgcacccaggaggcagagcttgcagtgagccgagatcgcgccactgcattccagcctgggcgacagagcaagactccgtctcaaaaaaataaaaaataaaattagcatggaatgggtttattgttatgtttaataaattaaatattttcaagttttcttaacattaatttctataatggtaagtattaatagatataaatcacatatattaaggctctttggtattctcaataatttttaagagtacaagggggtcctgagaccaaaatgtttgagaatctagcagataaaaatgacacaccagcagagagagcccttatgtaccacttcactgaggagctaggagcttctaacctaatcgtatccaatacccttctcatcctggttatcctacaactccacaaggttgtttctactgatgcatcacccatcagcatgtccttcttctgcccaaactgcaacccttgcacacacacataccaaaaaaacaaaaacaaaaaccttcaaaattacacatttctggcctggcatggtggctcacacttgtaatcctagcactttgagacaccaaggcaggaggatcacttaagcccaggagttcaaaaccagcttgaatgacaaaaataattaaaaattagctaagcatgatggtgcacaccagtagtcccagttactcagaaggatgagcaggaggatcgcttgagcccaggaggtcaaggctgcagtgagtcatgatcgtgccactgcaatccagcctgggtgacacagtgagaccctgtctcaaaaaaattgtacacatttatgccgagagtctaaagtcctaacacttaagaacctcacttgcctgtctctaatattccttcccccttcagcatgctgtaaaaggatagatgaatactctatcctaaccagttataatcagccttatattgtaacttcactgtgactttgcatctcccatgacccctgcctagaatatgatacatctcctctcaaactacccaactcctgtctgtcctgcaaggcccatttggaatccatcttcactgcctaatattgctatacccatcccttctccagactccagacatccctgttatctatttgtttagcacttaatgtgtgcttccatgtattattatcttctcatgaaatggatattccttcaataagatcataaaaatctacagagaatggacttcttcctttttatatcttcttcaacccctaataagtccttggacacataagacactcaatttataaacaattgctaattttgtagattaaggaaagaaggtgaatgaaaggagatttcaaactagcacactgtgtttgaatataattctgagaaatataaatcaataacctgggaatcatctaccaagacctctgaggaggcaaatattccagccataagtttttcttctcattctatgaaactttcctagaatcagtttaatgtggccctgatgctacaaataaactaatcctgatatcagtgtttctaagttgccgtaaagaatatagtaatgggctacagagaaaatcccaggctaaatgagaagaaaaaaattcctggaaagttcataaactaaaagtaataaaaactttatttccttctatttagatggcccatgggttaaattttaatgtactattcttttaggttttttatgtgtgtaattggacccatggaaatgcatgaatacctattccatttcctcacctctcagtcattcctcaacccattgtggtctggcttctattcccaccacttccttgaaattattctatacaaggtcactggaacctccctattgctaaatacaatgggtgcttctcaggccttatctctctgtttttttttttttaattcattgtcggcaacaaaaaatggaattgctggtttaccttaaattaaattaaatgatgcatctaggttgatgtctagatcatctgcttaaaccagcagaatagagagttcatgtgtccttttagaggatgatgaggagggaaaggaatattaatttagaaggttatgttggtttaaaattaatcatttaaaaatttatcagttaaaaaggttgaagttatttatcaagtatttcattcattcaacaaatatttcttgaatatcgcctaaatgtcagacattatgctagttatgggcatagcggaggctttccaggtaaacccagtcctttgcctcatggaccatacagactattgcagagtccatattaaggcatatataactgcaggggccgggcacggtggctcacgcctgtaatcccagcactttgggagaccaaggtgggaggatcacgaggtcaggagatcgagaccatcctggttaacacggtgaaaccccgtctctactaaaaaaatacaaaaaaattagctgggcttggtggtgggcgcctgtagtcccagctactcgggaggctgaggcaggagaatggtgtgaacccgggaggcggagcttgcagtgagccaagactgcaccactgcactccagcttgggtgacagagagagactgaatctcaaaaaaaaaaaaaaaagacatatataactgtagcatagtctggtaagtgtggaggtaggctccatgaatttggagaagacagaggtattagccaactctgaagtaatgggactgtcaaagccttcctggagaaagcagcactgaaggtgaaatgtgaaggaaaaagtagaaataaggctggagaaatatgggagtgggggcagatgcttctgccgtaaataccaggcaaatagtttagagtttattttcacaataatgggaagtcatgtgaggatagtgacatgctcagatttgcatattaaagattcaagttggctgggcacagtggctcatgcctgtattctcagcactttgggaggccacggcaggcggatcacctgatgtcaagagttcaagaccagcctgaccaatatggtgaaaccctgtctctactaaaaatacaaaaattagctgggcatggtggtgggcgcctgtagtcccagctatttcggaagctgagacaggagaattgcttgaacctggaagatggaggttgcagtgagctgagatagtgccactgcaatccagcctgggggagagagcaagaatctgtctcaaaaaaaaaaaaaaaaaaagattcaagtctgtgaactcagctctggaccaagctgagttaatagacatttacagaactctccaccccaaatcaacagaatatacattcttctcagcaccacatcgcacttattctaaaattgaccacataattggaagtaaaacactcctcagtaaatgcaaaagaatggtaatcataacaaactgtctctcccagctcagtgcaatcaaattagaactcaggattaagatactcactcaaaaccacacaactacatggaaactgaacaacctgctcctgactgattactgggtaataacgaaattaacgcagaaataagtaatttctttaagaacaaagacacaacataccagaatctctgggacacagctaaagcagtgtttagaaggaaatttatagcattaagtatccacaggagaaagcgaaaaagatctaaaatcaacaccataacatcacaattaaaagaactagagaagcaagagcaaacaaattcaaaagctggcagaagacaagaaataactaagatcagagcagaactgaaggagacagaggcacaaaaaaacccttcaaaaaatctctgaatccaggagctggtttttttgaaaagattaacaaaatagatagattgttagctagacaaataaagaagaaaagagagaagaatcaaaaggacatattaaaaatgataaaggggaaattaccacttatcccacagaaattcaaactaccatcagagaatactataaacacctcaacgcaaataaacttgaaaataaagaagaaataggtaaattcctggacacatacaccctcccaggactaaaccaggaagaagtttaatccctgaatagaccaataacaagttctgaaatggaggcagtaattaatagcctaccaatcaaaaaaagtccaggactggatggattcacagctctgtatcggtattcacggatacagaggagctggtaccattccttctgatactatcccaaacagtagaaaaagagagactcttccctaactcattttacgaggtcagcatcatcctgataccaaaacctggcaaagacataacagaaaaagaaaatttcaggtcaatatccctgatgaacatggatgcaaaactcctcaataaaatactggcaaaccaattccagcagcacatcaaaaagcttatccattatgatcaagtcagtttcatccctggaatgcagtgctggttcaacatatgcaaatcaataaacgtaatccatcacataaacagaaccaatgacaaaaaccacatgattatctcaatagatgcagaaaaggcttttgataagattcaacaccacttcatgctaaaaacgctcaataaactacgtattgatgggatgtatctcaaaataataagagctgcttatgacaagcccacagccaatatcatactgaatgggcaaaagctggaagcagtccctttgaaaaccagcacaagacaaggatgccctctattaccactcctattcaacatagtactggaagttctggccagggcaatcaggcaagagaaagaaatgaagggtattcaaacaggaaaagaagcagtcaaattgtctcgtttgcagatgacatgattgtatatttagaaaaccccatcgtctcagcccaaaatctccttaggctgataagcaactcagcagtctcaggatacagaattgatgtgctaaaatcacaagcattcctatacaccaataacagatgagagccaaatcgtgagtgaactcccattcacaattgctacaaagagaataaaatacctaggaatacagcttaaaagggatgtgaaggacctcttctaggagaactacaaaccactgctcaacaaaataagagaggacacaaacaaatgaaaaacattccatgttcatggataggaagaatcaatatcatgaaaacggccatactgcccaacgtaatttatagattcaatgctatccccatcaagctgccatttactttcttcacagaattggaaaaaactactttaaatttcatatggaaccaaacaagagcccataaagccaagacaaacctaaggaaaaagaacaaagctggaggcatcacgctacctgacttcaaactatagtacaaggctacagtaacaaaaacagcatagtactggtaccacaacagatatatagaccaatggaacagaacagaggcctcagaaataacgccagacatctacaaccatctgatctttgacaaacctcacaaaaacaagcaatggggaaagaatttcctatttaataaatggtgttgggaaaactgactagccctatgtagaaaactgaaactggatcccttccttacaccttatacaaaaattaactgaaaataaattgaagatttgaacataagacctaaaaccataaaaaccctagaagaaaacctaggcaataccattcaggacatagacatgggcaaagacttcatgactaaaacaccaaaagcaatggcaacaaaagccaaaattgacaaatgggatctaattaaactaaagagcttctgcacagcaaaagaagctatcatcaaagtgaacaggcaacctacagaatgggtgaaaatttcgtaatctatccatctgacaaagggctaatatccagaatctataaggaactgaaacaaatttacaagaacaaaaacaaacaaccccaccaaaaactgggcaaaggataagaacacttttcaaaagaagacatttatttggccaagaaacatatgaaaaaaagctcatcatccactgattgttagagaaatgcaaatcaaaaccacactgatataccatctcatgccagttagaatggcgatcagtaaaaggtcagggaacaacagatgctggagaggatgtggagaaatgggaaagcttttacactgttggtgggagtataaattagttcaaccattgggaaagacagtgtggcaattcctcaaggatctagaaccagaaataccaattgatggtttgcagtcccattactgggtatatacccaaaggattataaatcactctactttaaagacacatgaacacatatgtttattgcagcactttcacagtagcaaagacttggaaccaacccaaatgcccatcaatgatggattgtataaagaaaatgtggcacatatacaccatggaataccatgcagccataaaaaaaggatgagttcatgtcatttttagagacatggatgaagctggaaaccatcatcctcagcaaactaacacagcaacagaaaaccaaacaccgcatgttctcactcataagtgggaattgaacaatgagaacacatggacacagggaggggaacatcacacactggggtctgtcaggggctgcggggctaggggaggtatagcattaggagaaatacctaatgtagataatggctgatgggtgcagtaaaccaccatgtcacgcgtatacctaagtaacaaacctgcatgttctgcacatgtatcccagaacttgaagtctaataaaataataaaatgtgtatatatatacatatatatgtattcaagactggaagaaatgtagaggaaagagatatgtgaggcaagactggatgcagagggcggcagcagtaacagagtgtatgtgtattgaatacttacagcatgccaggcaaaagacagagtggctagacatattatctgatttcatctctactacaatcccataaggtaggtacaattttccccattacacaaagaggatgttggagcttcaagagattaactaagagatatttataagttattatgacaagacttatgtgcatttgatatgggaaggggaaagaaaaagtgaggagtcaatattaacatccagtttcacagcttagttcagtgagcagatagtaatacctatcactaagatgggcaaaacaggaataccaaaaggttttgatggagaaagagatggagttgatgagttttgtttgagacaggtttagacctgttgagttggggaaaagaaaagagttagacatcaattgtcagctgggtgcgcaaggctgaatctcaagagagaaatctgaagtaagccaactcatgtagaaagcatctacagatagataatcacagccatatgagtccttgaagatatacagaaagagtgtgtgacatcaaaataaaacaggctcgagatggaaacctgaggagcactaatatttaaagaatgagcaaaggaaatcaaaattgaaaagcagcagccagagaagtaagaaaaacatggcacaaacagctgcaagcaaggaaagaatgtgtttcaggtaggatgtaatcaacaccaacaaaattatcagagcggtgaggcctgagaagcacccactgaacctaacaataaggtggttccatgtgacttggtataaatttcagggaagtggtggggacagaaaaaagccagaaccaatggtttgaatagtgactgagaggtgagaaaacagaacaggcattcgcacctttctatggtccagttatacacagtaaatgaaacacaaagatcatggaatattcaggttagtcagagcaccgtggccttgctaatacagcatctgattaaagttagcccaaggaaaaagaactgaggattcaaaattggaatgtctggtctcccagaaaaatctggggactttgtctaacttttaccaaatgacttattcgtatctcagtttctgggggaactgatatgtcccaattttctcacaatattgtttcgagtatcaaatgttaattgtcaggaaataactttgcaaggttaaaaactagtttgtagaggaagtaataatgagttttagggccggccctgattattgcaagtacaactttaacaaggggaagaaaagacattttttccctcttttcactcaaacaagaggggaacatcagcagagaacatatgccagcttcaaataaatgattgtacagttcccagtggcttcaagaaaatggcattagttctaccttgacattcaggcacttggatgacacaagaggcacttggctttttggaaaataagtccttctgtgggatgatactcttcagcatgagaggcaatagtggaaagtgcatcggttatagaatccagtcaccctggaatggaatatgtgctctgccaatatgagtcatctgatttaaagtgagttacttaacctacctaaggttgagtttcctcaagggaataacaagagtgtttactccatgggatcaggaggtttaacagaatggtgtataaagaagaactgagcaggatgcctggaacacaagaagtgctccgtaattgttagtaaatattcttactaggacaggacctgtttcctctgccacagtaaaggccctacccacaacatttacttaaacagcgttcatcccaagactagagacagagccagtgtctagctgttcatgctaatgtgtaggtgaagtaaccgaataatatacttacgttctggggaactctgctcctgaagaaaactgtagagcattatgatttaacattcaaactctattacctggtaccatcatagcatgcatctcttaacataagggactgcatgttttatagaacatatgatgaatatttatataaagcaggaacttttgccaagctcagaatcggtgtactgattttactgttcgctgaagttcgggctaactttctgtttccctgtcgctgaagagatacatctctcacttcttccagttagactaaaataatgctcattctcttatctgttttctatccaacagggttcagctaaatgcagagggtcctggattcttcggcttgcaaaacccatatagaggtccatacagatttagaagtagatctcaatttaaaaccgcaattctatccatttctggaagtattatatggttccccaaacattcacatttcagtggtgatgccaatctggggcaaaaataataaaataaagccaacttctaaatgtagcatcagaagtcctctggaagggaggtaataatttcaatgcacattgaagtactcaaattattttattagtctctactcctaaggtttacattttcaagaatttactaccagtgtttggagaaagggaagtggaggtaaactgtaaaagcctctctgaaggtgagtcaccatggaaaccaagactgaaatcaaaggcactggactgacttatttctcactgatcttttttttcattaattcttgctgtcttttcatggctgtgctttcttcttttagttgacagacgcttgggtgttcagatcatcaatggaagacaattttgttaaggataatgtagctatatcgagtaacatactattatgatgataataactatgcattgagcacataatttgagccaggcccaatgctaagtattttacatacattgtcttttgtattacgtattattggaagcaatataggtaatggaaaaaagtcttatatctttattgagttggcacgtataacatactgaatatataagtgcccgaaatatgttaaatgctcaataaatgttaatattgttcttattttctagtccaaaaaactgtcctatgagtaaggctctttttttctcaatttacggatgtgaaaactaaggattacaaaaagagggtaagtcacttggctgtgatttcccaggtggtaaacaagagaattagaatttcagcgcaagcttgcctgactccagaagccagattgtaaaccattatgctgtattctctaagatagttagaggtctaagaagctcaccaaataaattggttacaattatggtttattttttaattaggttcaaagaactaaagacttagaggcattatcaatgctcacttgatttttttctctagctattcaattagttatttaaagaaaaaaagtcaaggtgttaaatatttggccttggagggcataatgctacatttcaggttcacctttaatctagactcaacagatttttgtttttattctccttaaacttcaggccaggaaaaacaacagagtatctttagaaagagacggaagccaaattaaacaaggctccattctgaatgttttctatgctcccaaatcctatcaacacaaaggtaattcgatgaaaggttcatttctttataaaataaatctcaaggctactgaaacagacaattgggaataatttgagaataaattaattagttttgattacaaacaggaatctactgttatataaagttggaaatgggaaaattctgaaaattacctagttttttagatagcctagagtttagtaacattctttttttaaaataaattgcattgtaaatgaccctaatactagctgtttgcacttagtaatgtgtacatcccttgaggaaacaccacttggaatacaagtaacttgcaaacccattaccagccacattaaattgccttcattagatgttgcttttcttttcctgaggatcactgatccttctcaacttcaggccttattttccatttctatttatattcctatttttctcccccaatccctactaccaccaaaaggaattcacttttctcaaaaaaaaaaaaaaagaatcaaaagtatattaaatttaaagaaaacacctttaaacaattattatggttgaaaagtaataggtttttatgactagaaagcagaaaactaagtccctgcccctcaatatatcccaagataagaataaatcatggaaagcataacagctgcaaatctcccacccagatgagagaacaaccctagggaacatccctagagagaaagatctatcccaattatggaaagttcacctgataactgtgtgagaaagctcaaactgcctcctagcagcactgtcttacctatagttaagagtcagtgattctgttgaagtacttggctcggctcacctactcttccctccttgcttcaactcattccccaacacctatgcacaaaccactttctccagtgttgtgcagttaagaatgcaattgcttcagaggcatcataagggaagatttccattctaaaccgccagaagagacagtggattcattggccgaaaacttctagcataaaagtgagaaatgaactgaaaggtttcatactagacatgcctgaagtctatccatagaagaaagtactattgttgctcaaaatatagtcccttaaaaaaattcattatatatgaaacaataaaagaaaatttcatcctctaaaaaagaattcatgtaattcacatgaaaattcatcacatttggtataagcaagagttcaatcaataaattttttaaaaaccaaaccagataagccaaattgactgagttataacttttccatgaggcatttccaaccccaaaaaatccctcacctttctaaactagtagcagatgttttctagtatccatgtgacaatcatatatggccttgtgatatgttttacaatgtctgctttcgtgattactgcagctttgccttccatagtcacttttcacagtttccatcttatttctttttttttttttttttcgagacggagtcttactttgtcacccaggctggagtgcagtggcgccatctcggctcactgcaagctctgcctcccgggttcacgccattctcctgcctcagcctcctgagtagctgggactacaggcacccaccactactcccggctaattttttgtatttttagtagagatggggtttcaccatgttaaccaggatggtctcgatctcctgaccttgtgatctgcccccctcagcctcccaaagtgctgggattacaggcgttagccaccgcgcccagcctccatcttatttcttaattataaggtctctgaggacaaagacaagtcatcatcatcgtagcctccacagctctagtaccatttccttaatgtgactaagcaatgtaaccagataggcagtcgatgactagtaacttctccctgtagttcaaaatctaaggtcatggttgctctagctagagaaagtatggttttctagattgtaattcaaaaaatgcactatagcatagtgtgtaagactgcctgaggttctaccacttacttcgtgacgttggtccagttacttaacctctctgtgccacatttttcttacacataaaatgaagataataatgggacctttatcatagagttggtatgagtatgaaacatgataatacaaataaattggttaagggagtaatgccacacagtaaaagattaataaatcctagctataattattacattacatataaaagggttcatatgactcctagaatagtgggtaaagatgtgattttgggagttagatatgaaaggaatgaaaagcattttcctaatggatcccaatcacacctggcatcaaggcaaactaagctcttgacatcacagtcaaatgaattacgaatgtccctcattttcccaaagccttgaaatacaatcaacacactgtacacaatcaacttatgtgagagtgatctaatagatcagaatggggccattgtcttggaggattcttaacaagagacctaggtaacctcaccctctgtcctgcccttccagtttctcacctgaacaagcaggttagaaggcattcctagaaggtttacccccaccatttctcagcacataaaggggaaaaaaaaaaaagaacaaatgttctttatctcttctgtccatagtcagtgcttcccagaaacaccctcatctaacccatcattacccccaccccaggaaaaagtgcagtagatgacaacaggcaatgcaaaaaacatgtttgcagtatccacacacatacatacactcctttttgctacataccactagcctggccatccattaatatgagcccggagttattctttctccttctggcatcacagggtcagaagataatgaaggaagagatctagcaatacttaaataaataatgattacaggcaaaatattgaaatagaaaaggcttatctttggggccttttgcatactcttcagccatgcctgctcttcttgaagtctctgaaggcagagcctttatattaccttctgagtttctccaaattcaagtggtccttacatctcatgaaatccactgcagatggctccttagctcccaccttgacccactccaatacattccacactctcatgtcagattaatgttctgaaaacacaggtcttatctcacattggtttttaaacacatttattcctagtgttccattattgaaacactaagcatgtgggagttatttatatcccactgctcaaggtcattgccaaggtctgattgcaaaaattcaaaaaattgcaacctcaggcataaatgggttagttccttaatcaggcatatcactgtttcgtgcattataattatatgtgcatatgtcatgtctcctccaatagactgtaaagtcatgtgaggactcaaattatcaaactcatcttaaaccatcttcacccatctattcaaaaaaattataatgaatacatgttataaaccaggcactacactagtctctagagagaggagtcagaccatgcccttcaacttgttaaaaatcttttggagggtagagagaggcagcaggggttatagccacataagcagaaaactgtaatacatataaaataatttacatgttataatataattgcaatatataatatgttataattgcacaagcaccaagaaatacaggattgcattgaagggacttcgactacactcttgagaagatcaagaaaggcttctcagaagaagtaatgtctaaactgataccagagcataatcaggtatttctagagaaccaggcagtgtaaatggtccattaagattggaactgtgacaaaggatacggtttaagaaacatacagggaccaaatcagaaaaggactttgaagccactctaagtgtttgtagtttatctaaaagtcactgaattgtttaacaggatgaatgatatgatcagatttgtatttttaaataaccattcaaattagagtgcagcagtcatttaaaatgtctgctgaacacaggaatagaagtgacatcagcatggtaaaaaatatttcaggaattcagaaaatagagaaatcagtaaatcagtgctggctgtgataccccagaaaggttttatggtgaagtttaactgggcttaagagagtagattttcacagggcaattcaaggaaaagaagaacatttcagtcaaaggcaggaaaggtccaaggaagataatgagttaagaagtggttgagcaaaagcttatgggaatccatagagcagtgagtagtttagtttagtgggtgctaggtctggagaggtaggttgacacaggaggatcaggccttaaatgctaggctcaagatttagagtttgccagctgagacagttcatggaggctttttgaaagagtgttgctttgagaagactgaatatgaactgaaaaaggttaaaaacagaacttggttaccagtagaaatgtgagaagaaaaaaactatgtgcactacaggagatgggctgcaagatatatatcaaaaaatatatatcagaagaagaaattctgaatggaggcatttccagcagctcagtgtgataatttagaaaataggatcttccttttatcaggctgtttaaccactatctacacataagaacttgaaaatacagtgtttgaaagaggaaatgaggaaaaggaacatttgaagaatgagaaaggaacagctgaacaaacaaaaggcagcactgaggccattcttaaatgtcctagattaataacccaggggtatccagatatttggggcttccctgtgtattctaggaactcccctcaatagatcagacctttatccagaaatgagggccccagagacctatttggctaaaagggctccctcttctttgttgttttggtcactgcttctacctaactcttcgcactgtcagtagctataagaagcaaaactattggctcaattgttctactgtctacagtttgaactctgacctctttgatatcccaaagcaacaagctaatttagtagtccttacttaaggatacgaagaaaaatatttagaaaaccttccaaaattgtctaacaaatctccagagttcattagtctattacctgagaaaagctgacctaataaatatcacagccctcaaccaaaagaacaatgttatttgaaaactaaatcttgtagaagattcaataaattcctggaccttgaaacaaattttatcttcttagcctttttcaaagccaaaaaccagtgtctcacaatagacatgtgcattgtttattccaccctgtgaggaaactgaagttgtattcctcagggtatgtaagcattaatgaccctaaaattttactccagaattgggtggtttcacactggagcatacatgaatgttgtgggctcaagtccatcacttaccagcaaatcaatggattcttttagattggtatttcatttgtcatcatttaaccaatgattattgtcatcattaggactttttagaacatcaggcaaggtaccgtggctcatgcctgtaatcccagcactttgggagaccgaggccggcggatcacctgaggtcgggagtttgagaccagactgaccaacagggagaaacctcatctctactaaaaatacaaattagcccggtgtggtggcacacgcctgtaatcccagctacctggaaggctgaggcaggagaattgcttgaacccagagggggaggttgtggtgaactgagatcgtgccattgcactccagcctgagcaacaagagtaaaactcagtctcaaaaaaaaagcaagaacatcaaagagatgtttgttaggcttattaagtggtaaattttccttggcttccttttctttccaaggtaattatgggcttcttcctgtctctttttgatgcccacagaggccataatgagggcagttaaatatgcaaacatgagaatgagaaaacaggtgtcaagatacatataattttacctattgagacatcctgcctgctaataaacagagaatcgtattactggtacacttaaccaattttcctaaataatttaggcatgttttccaatgtctttgcaaaggtgatgtggggaggtcttttgcccctttaaaattcatcaacacctccagacactgcaagataaggaggtcatgcaagtcaaaacaatgtgtgggctacagatatgcagcttcaagtcaatcctctaaacttctttccaagcacgtgaccatacctacctggaaatactggagtcagctcagttgtttcccctatttgataagaaaagaatgcaactagccagcaaacactttattttcttaaatattagcataatttgtgggcatttccatttttccaacacatcatttctcagatattaccccagataaaataccatgcccagaactggaattatagacaatttactaaagaacatgcataaggggaccacaaaacccttctagatcaaagagagaccacctctgacatgccatggcatcagaaagttctacttttcttaagagccatatactttaattgtggtaagatatttctaacaaaaagatcaatctacgtataatgttattaacatggaatttatttgattacagtttccctaactgtaatctaaagtcatattcattaggaaacgccaaatttccaagagcagagtataatatgcagcatttcccaaacatcttggaccccaaaaacttcttgtaacaaactaacatcgtccaaaaatgacaaacgatatggaaaataccgtattctaccctccaatatcagctgtcagtgggacaggagtaaaggaaaacaagtcaaagcactgagttaactgagttttaaaagacggagagcagttttggaaggatgcagaaactacactttgtctacttaacaattttaagaactacccaatcacagagtatttattatagaaataattaggaataatttgattttatgtttacaaagaggtatgatgtttaactgctcctacgtagtttgaagcttgttcttaaacccaaggtattgccaaatgcctagtagtaccctgtttattactgaaaaaatttttttaatcattttggataaatactagaatcaaatatttgacctgacatatgacaaggaactaacaatataagcctagtctaccaccatctggatgaccaaattagaatcttagtctcaaggccgcccctgtttcagccctgaatgcctcatgtaatgtacacaggagccagaactacattatatctcgttttcaaatagcactggttacgcaccgggcaactgttaaccagggtggcatgtgataatcttccttgctaaccttgtaggaagtgtgcgagccgttatctttctggcaagatttaagtaactcattcctatctaaaaagcatctgttaaagtggcgtcacaccctcaactacttcataaagttttctataaaatgttaaaatcaccagagtcggacctctcagttcatcaggcgtaaaactgcagtttccggctgccaaatcccttaacaacgttaaccttttaatccttcagcctcgtctagtgaaaagcaagtgtcaccagataccgccttctacttgagaaatataacaagattctttctcctgcacttttcccaaataaaaacggctcatatacaaagtgaagtctagggacacccacagtacggagggctgcccggacctggcggccttacctggttgaagtgcagctggccaggctccgggacgcccacgcgggaggcggctcccatctgctccagcaagtgctggagctgcgccgccgacaggctcagattcgcgccgaacacgctcagcacatcctcgctgaaggctagccctggcccctccgccactcctccgaggccggcggccgccagcaacaggagcccggccaccgcgcgacccggggccatcctggcctgggcttccccttgagggcccgcgacgggctgccgcgcagagggacgcgcgcgggcgcactggcgtccttgcccaagggcgggagcgtcagtgctcggcgctgctccgagtcagaggtggcgcgggacgcccctggttctccgacgccttcgaaagaacagcagctcgcgacctgcggggcattgaagtggcagcgtagccgaggggagcgataggcggagtgggccccccggcctcctggagagcctgagataaagaggacaaagggggacagagataaaggccaccagggcaccagccggcaggctccagaaacgctgcgtggcagtagccctcaaacgcccggccgggcatggggccagacgccccggatccgggtttgcaaacgccccaggatttgcgtacatatgctcctcccggatataaagccccaaaccacgccacttcttaggaaaaactaaaaccacactaactgtagaactccacctcctcttcctgtctttctgctttattctctccgccgcaaacttagaagtgagacgtgcagtccccaaggagctgcagaaaagggctcttccggagtc

SEQ ID NO: 2108 - DNA, 62650 bp, Homo sapiens
acatggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaactagaagacagatatattgttagataactgttgccatcttgtggcaaaccacaaaacagtcacttagaggcataccttggagacagtgtgggtttggttccagaccagtgtgataaagcaaacatctcaataaagcaagttacatgaattcccaggtttcccagtgcatataatagatatatttgcattatactgtagactattaagtgtgcaatagcataatatctaaaaaggcaatgtatataccataatttaaaaaaatactttattgctaaaaaatgctaccaatcattcgagctttgggtgagttgtaatctttttgctggtggagtcttgattccatcttgatggctgctgactgattagagtagtggttgctaaagatgggagtggctgtggaaatttcttaaaataagacaacaatgacatttgcaacatcaatttatttctttcatgaaagatttctctgtagtgtgcaatgctgtttgacagcattttacccacagtagaaattatttccaaagtggaggcaatcctctcaaactctgtccctgctttatgaactatgtttatagaatattctaaatcctttgttgtcatttcagcaatgttcaccaggaatagattctgtctcaagaaatcactgtttgttcctccgtaagaagcaacccctcattcattctagtttaatcacgagattgcagcaattcagtcccatcttcagtctccacttctcattctagttatcttgccatttccactacctctgcagttacttccttccctgaagtcttgaacacctcaaagtcatccatgagggttgaaatcagcttctttccaatttcaattaatgtggatattttgactccttccataaatcacaaatgttcttcatatcatctagaaggataagtcctttctagaaagttttcaacttactttgcccagatgcatcagaggaatcactatctacagcaactagagacttacaaattattcttaaatgatatgatttgtaagtcaaaactactccatggactgatccatggactgcggaatgtatgttgtgttagcaagcacaaaaactttcatctccttgtacatctccataagagctcttaggtgatttgatgcactgtcaatgagcagtaatgtttgaaaggaatttcttttatttttctgagcagtgggtcctaacagtgggtttaaaatactcactaaaccatgctgtaaacagatgtgttatcatccaggctgtgttgttctatttctagagcacagagtggattcaacataattcctaagggccctaggatttggggaatggtaaatgatcactgacctcaacttaaagttaccagctgcattagtccctagtaagacagtcagcctatcctttgaagatttgaaaccaggcattgacttctctctagtatggaaagtcctggatggcatgttcttctaacagaaggctgtttcagctacacttaaaatctattagtttagtgtagtcaccttcatcagtgatcttagttagatcttctggataactttctgcagcttcccatcagcacttgctgcttcacctgacacttttatgtcatacagatggcttctttccttaaacctaatgaatacacctctgctaatgtccagtttttcttctgcagcttctttacttctgtaagccatcatagaattgaagagagttattccttgctctgaaataggctgttgcttaacggaatgttgtagctggtttgatctttctatccataccacgtaaattttattcatgtcagcaataaggctgttttgctttcttattatttgtgtgttcattggagtagcccttttaatttccttcatcaatcctttctttgcagtcacaactgggctatctggcaaacaaagtctagcttttggcctgccttgggtttcaacatgccctcctcactaagcctaatcatttcaggcctttgatttaatatgatagatgtgcagctcttcctttcacttgaacacttagaggccactgtaggattattaattggtgtaatttcaacattgttgggtgtcaaggaatagggaggcccaaggagagggagatggaaggatggctgatcaggggtgcagggagaaaacacacacaacatttgtcaattaagttcaccattttatacgaatgtggttcatggcgtcccaaaacataatagtaacatcatagatcactgatcacaaatcactataacagatattataataataatgaaaaggtttgaaatcgtttaaaaattaacaaaatgtgacagagacaggaaataagcccatgctattcaaaaaatggcactgacagatttgcttgaggcagggttgccaaaaactttcaatgtgcaaaaaacctagcatttacaaagtgcatcaaagcaatgtgcaataaaacaaggtgctcctgtaatagaatgctgggaggggtggtatgatcatttactttggatgtttaaaggttttagtactgatagcttaataggaatatctagttctttcaggcatcaacaagagtaaaagtactgaagtagtatttttctccaactgaatcaatcagtgggatggaatttacctcattttatgttctctttctccttttccattacctgctctctatgcttcacccaacccattctttcatgacctcaagtttacccagcaaaatcttcacatctaccatcacctgtaccagaacttgtatttctctaatttttcagtggactaaatccttcacgttttaccttatatcttgctaaaacacttttgctagctaatcctagtttattctagattcctttattatcatctctcatcatatattctactttctctcttatttcatagcattttttattatttgtaattatttagtcatctgtgtgattttttgttgtttaatttaaggatcccctctttctagaggaaaagccccatgaatggaaaagccccttgaactgtgcctattttgctcactccaggatgagtattatttcttagtattatttctttaaactgaacaactctagtaagattccattcttatatcagaaagtaaaatgactataagatagcatgagacattaattttgtgacaaaagttataaatgtagcattggttctaagagatgaaatccttgctcttctgagggtctgcagagaacaacgaacagagctagacaaatataatttggaggtaagaatgcaaataaaaaactcaaattattaaattatgtatgtaatacatccagttccaaatgcaaaagaaatagtccttgattttcatacactaccatattatcattttatagaaagatttccatgatttattttaaaatgcacaggatattctctctcttacacacacacatgcacactcttttttttttagatggagtctcgttctgtcgtcaggctggagtacagtggcacaatctcggctcacagcaacctctgcctcccgggttcaagcaattctcctgcctcagactcccgagtagctgggattacaggcgcccgccaccacgcccggctaatttttgtagtttcagtagagacagggtttcaccatgttggccaggatggtctagatctcttgaccttgtgatccgcccgcctcggcctcccaaagtgctgggattacaggcatgagccaccgcacccggccatgcacgctcttttgagcacaaacacacacatacacacagatacaaagacacagacattgaacagatataaatatatactatgtcaaataactattgtcaaaattttaccaattttagtgtaccagttttagtttaacccaaaaagctgtcactgtttagaactttgaaataacaaaatgctatttactctaataagttattcctcttccaaatgtggcatagacacaaaagagggagaaaaaggagaaaaagtcctatagggacatactataacataagacaagatgtaccaaccacaaggggaatagagatagaggaaaatatctctatttcagcaaaaacaaatcatttcaccttcaaacaatacgattatgttttaaagaaccagtgaggatcagtttcaaattactattagtgtaaactactcaagtagaatgatctgttgaaatgggattgttctgaattacaacagaaaggccttccacactgcggaaagcagaaggccacccttagttaacttataatccagatactcatttccaaattttaaattaaaagaaaatacaaattttaagcttcttaccatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctagaagaagaagaagaaaatatcaagtgaatagttttttttttatttctggatgatatcaaagataatcatcaatgtccaacaaggtcttcattttagtgcatcagaaggattttaagagcatgtcacctgaaaagtctcattccactgaaatcaagaagtaagcagacttttacaatatgaacagagctccttacctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctagcagaaaatcaattaaaatgataaccaacatttcttgaaagtctcagaaatacagacaagttggagatgggttgtgcttgagaaaaacaaattgttccaacagaaagtcttttagagtaactaggaaaccctaataatatataacagagcaaagaaaacttatggttgagagaaaggaaattcatcaactgacacacctcgaataagccactaacagatattttcctttactttccctttaaaacaattcttttgacttgtataaacttcttcctactgcctttctaaaatgtagcagatattaacctaagaaatttatttatacacaagatttaaaatgaaggaagttattcaaagactaaacttaaagtcttttttatgttacaatttaaatgtgaaatccacaactagagcatgatgaatgacatcagcaacatttgttctaacccctcctatgccaccatgtgacagggagcaagttatcacagagttccttcaactgtgaaatgaagacattgtactaaatgattcatttatttatcaacaacttattgagtttccattctgttccaggtaccctgtggagggtttaggctgtaacaatatggtctctaccagctccaaagcttaattattttcttaacaaattgcatgaagtgtaaatggaacaggctagcctttacactaacacttcctttcatgtagaaacaattaaaaaatagaaaatcctgtgatggactctttgtaggaatttagatttccagaaaatttacaaaattgtacaaaatcaaatgacaaatgccaactaaaacactttccagaagttgtagaaaaagataaaatgcaaattcatttttaagtacaaaagcactttgcaattaactggagaacattttattcctaattctcctcctctcacctctacctaagcagctaatcattacatttattgaacttctgaaatttgtaaaacactctgttgaatgctataggaaatacacagaaatggaaaacacagcttctgtcttcaagaagtgtatttacattggagaaacaagtcataatatatatggatacattaaaaaaaaaacatgcaatatatatccaacagagaggggcttacttcagagcaaccatctaagaggttttacagttactccaatatcacttcaccactccaaacactttggggaccaacactttcagaatcagccttagatcctgcaatacatctctttactatttcgttagtggcaaatctgcacctttggatttttgtttgtttgtaggcacagataaaagcatttggagcaaatatttttttaattaatatgaaatgaatgggaaactgttagtaataggattcatcatcattgtcatcaccaatgtggtcgtagtagaaatagtaacagcaaaggcacatagcatttataatgtgctaggcactgttctaagcacttcaaataccgaattcatttggaacaattctatgaggaaagtacaactgttaccatcattttatagttgaggaaattaaagcacaaaaaggttggtaaacttacccagagatacaaaaaaagagtgaatgggcatttttggcaacagtgctttactactacacacatatcggggatgggaattcttctctgtaataggatctgaaggtaattcgcaaggagacttccccacctctcagaaaactcttctgaacgcttgatgcaacattgagtaagtatcaaatcttttttattttaagaaacaaagcttatccgcataaaaaattctatcttttcttaaaatgtgggctttttattttatagctgtatcttaaacgcacaacacaataaacaatcataatttagcacaggtggatcgggtagtttgcataaaaaatgccccagagcgggaagcaattacagctgaaggagaaacaaaggtggtcatagggaaagccacagaggaagtgacctgggctttgtaaaacttaatgccgtgatatacttaatgagattattttgaattaaagcagttgttttcatcttccaatctaatttgtctaattacatgtttaaaatttccttattgtgatgacttcagaagaagactacaaaaccaagtcttgactacctgatatcactacagagtctgtatacaaacacccttaattttacagaagaaattaaattaatatatcaggaatgattctcatacctctaagtacagatattattgactctatttattatgcctcatgctttggtcccaaatgatactgttgagcaggtaagagttatacatttttaatagttttggaacaaaccaaagtcagcaaaccttcacagaaacttcttttttaattcacctagaattaaatcactgagcagagagaacactaaattcaagttcctgtagttaaattagtgaatatgcctatctctctctttcctttttaaatttttgttttctattgttattgttgttcacttgcttgctttcttgtctgagttttactctaaatatgaggctatttctatcctcagccatgatgaggcaattcagcctagtgaaaagacactaagtctggaatctaaaactgagttcaagcttggctgtgagaagaattaccgtgtaatcttcagcaagacttgtaacacctttcacttagttattaatggggatggaagtcaaagcaatgtgtagtgttatcagaatgggggagaaagaatatcatgcaccaaagttaaaaaaatagagggagactatgttgaatcccaacataaattggagggcaaaaaacaaaatttttttcaaaaaaagtacttagaaattaaaatggagaaaacaaatgggcttattgcagaacagtttaaggaaggaggagaaagttgtagaggatgaggaggcctgggggaatagggagcacaaggaaagggagaagtagcatgaggaggaggaggaggaagacaagtataaggaggatgagaaggaggatgaggaagaggatgaagagaaggatgattaggaggaggacaaggtggagcatgtggagaaggaggaaaaggaaaacagggagaacaaggagaaggaaacgagcaagcatgagtaagaggagcaggaagaggactaaaaggaggagaaagataaggacagacaagaaggacacaaaggaggaggtgaagaatatatggaagagtctcttttaataagtacagaatgtgaatctaattctattccactaaatctcataaaaggccatcacagaggatagcttcagtaataaagtgaacaagaaaatctgattgtcactcagtatccttcatcaaccatccaaatgtttgcttaatggacccacatataaagcacagagtggtgcagagggaggatatatataggttcagcattctcttctcctaccagggggaatctggctttccagcactaaagaagtcccaaacttcaaaagccaaggctgatgctgagcccccaaaaagctatcactgtccaacagggcaagaggaccaggtggctgtatgtggtagcagaatgattccactggattcctcccattataaggggatgctcttggactcacaaagatagacatatacaatatatgtcttccctgccttcagtgcctctgcaagcaccatcattcatggacttatagtgcaactgatatatagccaaggtttcctgtgaaaactatctcctaaccattttttagcaaaggaagtgagacagtgggctcaatacatataattcatggatcacatcacctgcaccctctagtagcaaccagtttgacagaatgatgaaatgtcctgatgaagcctcagccagggtgcaagccaagagataacaccctgagaggttggagttctgttcataggttgggcagccaagtatatggtgtcatctctgctgtagagaatgcacaaatccaggaaccaagaggtgagagtaaaaggggtataagtcaggctcaggggctcctgccagtaatcccagcactatgggatgccaagggggaggactgcttgaggccaggtgttcaagaccaacctgaacaacataactagacctcgtctatacaaaaaatatattactttgggaggccgacacaagcagatcacgaggtcaggagatcgagaccatcctggctaacatggtgaaaccccgtctctactaaaaatactaataaaaaaaattagctgggagtggtggtgggcgcctgtagtcccagctactcaggaggctgaggcaggaggatggtgtgaacccgggagacagagcttgcagtgagccgagatcgcagtgagccgagcctgggtgacagagtgagactccatctcagaaaaaaaaaagaaagaaagaaaaaattacccaggtatggtgtcatgagcttatgttcccagctactcgaaaggctgaaggagagttacagtgagctatgattgcgccactgcactccagctgggcgacagagttagaccttgtctctaaataaataaacagataaataaagtaatctatcttatttttatgcctaatacaccacttaaagaattcttactgacaggccagatggccaagtaggaacagctctggtctgtagctcctagccagaccaacgcagaaggtaggtgatttctgtatttccaactgaggtacccagttcatctattcaggatggttagacagtgggtgcagccctctgagggcaagcagaagcagggtgaggacccaggaagtgcaaggagccggggacctccctcctggagccaaaggaggccatgaggagccatgccatgagggacagtgctctccagcccagatactatgcttttcccaaggtctttgcaacctacagaccaggagattccctagggtgcctacacctcaagggccctgggtttcaaccacaaaactgggtggttgtttgggcagacaccaagcgagctacaggagtttttttccataccccagtggtgcctggaacaccagcaagacagaatcattcactcccctggaaagggggctgaagccagggagccaagtggtcttgctcagcgggtcccacctccatggagcctggaaagctaagacccactggcttgaaattctcgctgccagcacagcagtctgaagtcaacctggggcactcgagcttggtgtggggaggggcatctgccattactgaggcttgagtaggcagttttcccttcataatgtaaacaaagcctccaggaagttcaaactgagcggagcccaccacagctcggcaaagccactgtagccagactgcctctctagattcctcctctctgggcaaggcatctctggcagaaaggcagccgccccagtgagaagcttatagataaaactcccatctccctgggtcagtgcacccacgggaaggggtagctgtgggcgcagcttccgccgacttaaacgttactgcctgccagctctgaaaagagcagcagatctcccagcatagtgctcgagctctgctaagggacagactgcctcctcaagtgggtccctgacccctgtgcctcctgactgggagacacctcccagcagggctcaacagacacttcatacagaagggctccaactggcatctgatgggtgcccatctgggacgaagcttccagaggaaggagcagacagcaatctttgctgttctacagccaatgctggtgatacccaggcaaacaggggatggagtggacccccagcaaactccagaagacctgcagaagaggggtctgactgttagaaggaaaaccaacaaacagaaagcaatagcatcaacatcaacaaaaagaacggccactcaaaaactccatctgaaggtcaccaacagcaaagaccaaaggtagataaagtcaccaagatgagggaaaaccagcacaaaaaggctaaaaattccaaaaaccagaatgcttcttctcctccaaaggatcacaactcctcaccagcaagggaacaaaatcagacggagaataagtttgacaaattgacagaagtaggcttcagaaggtgggtaaaaacaaactcctctgagctaaaagagcatgttctaactcaatgtaaggaacctaagaaccttgaaaaaaaagttagaggaattgctaactagaatagtcagtttagagaagaacataaatgatctgataaagtcgaaaaacacagcacaagaacttcgtgaagcatacacaagtatcagtagccaaatctatgaagcagaagaaagtatatcagaaattgaagatcaacttaataaaataaagcatgaagacaagattagagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagcaagataggccaaaattcaaattcaggaaatacagagaacaccactaagatactccttgagaagagcaactccaagacacataatcatcagattcaccaaggttggaatgcaggaaaaaatgttaagtgcagccagagggaaaggtcatgttacctaaaaagggaagcccatcagactaacagcggctctctctacagaaactctacaagccagaagagagtatgggccaatattcaacattcttaaataaaagaattttcaacccagaatttcatattcagccaaactaagcttgataaatgaaggagaaacaaaatcctttacagacaatcaaatgctgagggattttgtcaccaccaggcctgccttacaagagctctgaaggaagcagtaaatatggaaaggaacaaccagtaccagccatggcaaaaacaaagcaaaatgtaaagaccattgacactatgaagaaactgcatcaactaatgggcaaaataaacagctagcatcataatgacaggatcaaattcacacataacaatattaagcttatatgtaaatgggttaaatggcccaattaaaaggcacagactggcaaattggataaagagtcaagaccgatcagtgtgctgtattcaggagacccatctcatgtaagaagacacacataggctcaaaataaagggatggaggaatatttaccaagcaaatggaaagcaaaaaaaacaaaaacaaaaacaaaaacaaaacaaaaaagcaggggttgcaatcctagtctctgataaaacagactttaaaccaacaaagatcaaaaaagacaaaaaagggcattacataatggtaaagggatcaatgcagcaagaagagctaactatactaaatatatatatgcacccaatacaggagcacccagattcataaagcaagttcttagagacctataaagagacttagactcccacacaataatagtgggagaatttaccaccccactttcaatattagagaaatcaatgagacagaaaattaacaaggatattcaggacttgaactcagctctggaccaagctgacctaatagatatctacagaactctccacccccaaatcaacagaatatacattcttctcagcaccacatagcacttattctaaaagagaccacataattggaagtaaaacactcctcagcaaatgcagaagaacggaaatcataacaaacagtctctcagaccatagtgcaatcaaattagaactcaggattaagaaactcactcaaaaccacacaactacatggaaacggaacaaactgctcctgaatgactactgggtaaataacgaaattaaggcagaaagaaataagttctttgaaaccaatgagaacaaagacacaacgtaccagaatctccaggacacagctaaagcagtgtttagagggaaacttatagcattaaatatccacaggagaaagtggaaaagatctaaaattgacaccctaatatcacaattaaaagaactagagaagcaagagcaaacaaattcaaaagccagctgaaggcaagaaataactaagatcagagcagaactgaaggagattgagacatgaaaaacccttcaaaaaatcaatgaatccaggagctggttttttgaaaagattagcaaaataggtagactgctagccagactaataaagaagaaaagagagaagaatcaaatagacacaataaaaaaaatggtaaaggggagatcaccactgatccacaggaatacaaactaccatcagagaatactgtaaacacttctacgcaaataaactagaaaatctacaagaaatggataaattcctggacacatacagcatcccaagactaaaccaggaagaagtcgaaaccctgaaaaggccaataacaagtcctgaaattgaagcagtaattaatagtcttaacaaccaaaaaaagcccaggactagagagattcacagtcgaattctaccagatgtacaaagagaagctggtaccattccttctgaaactattccaaacaatagaaaaagagggactcttccctagctcattttatgaggccagcatcatcctgataccaaaaccaggtagagacaaaacaaaaaaagaaaatttcagcctaatatccctgatgaacatcgacgcaaaaatcctcaataaaatactggtataccaaatccagtagcacattaaaaagcttatccaatatgatcaagtaggcttcatccctgggatgcgaggatggttcaacatatgcaaaccaataaacacaatccgtcacataaacagaaccaatgacaaaaaacacatgattatctcgatagatgcagaaaaggccttcaataaaattcaacaccctttcaagctaaaaacactcaataaactaggtattgatggaacatatctcacaataataagaactatttatgacaaacccacagcccacttcatagtcaatgggcaaaagctggaagcagtccctttgaaaaccagcacaagacaaggatgccctctctcaccactcctattcaacatagtattggaagttctggccagggcaatcaggcaagagaaagaaataaggggtattcaaataggaaaagaggtagtcaaattatctctgtttgcagatgacatgattatatatttagaaaaccccatcatctcagccccaaaactccttaagctgctaagcaacttcagcaaagtctcaagatataaaatcaatgtgctaaaatcacaagcattcctatacaccaataacagacaaacagaaagccaaatcatgagcaaactttcattcacaattgctaccaagagaataaaatacctaggaatacaacttacaagggatgtgaaggacctcttcaaggagaactacaaaccactgctcaacaaaataagagaggacgcaaacaaatgaaaaacattccatgctcatggataaaaagaatcaatatcatgaaaatggccatacagtccaaatttatagattcaatgctatttccaacaagctaccattgactttcttcaaagaattagaaaaaaactactttaaatttcttatagaaccaaaaaagagcctgtatagccaagacaagcctaagcaaaaagaacaaagttggaggcatcacgctacctgacttcaaactatcctacaaggctacagtaaccaagacagcatagtactggtaccaaaacagatatatagaccaatagaatagaacagaggcctcagaaataacaccacacatctacagccatctgatcttcaacaaacctgacaaaaacaagcaatggggaaagaattccctatttaataaatggttttgggaaaactggctagccatatgcagaaaactgaaactggaccccttccttacactttatacaaaaattaactcaagatggattgaagatttaaatgtaagacctaaaaccctagaaaccctagaaggaaacctaggcaataccattcaagacataggtatgggcaaagacttcatgactaaaacacaaaaagcaatggcaacaaaagccaaaattgacaaatgggatctaattaaactaaagagcttctgcacagcaaaagaaactatcatcagagtgaacaggcaacctacagaatgggagaaaatttttgcaatcttatccatctgacaaagggctaatatccagaatctacaaggaacttaaacaaatttagaagaaaaaaacaaacagccccatcaaaaagtgggtgaagaatatgaacagacacttttcaaaagaagacatttatgtggccaacaaacatatgaaaaaaggctcatcatccactgatcattagcgaaatgcaaatcaaaaccacaataagataccatctcatgccagttagaatgtcgatcactaaaatgtcaggaaacaacagatgctggcaaggctgtggagaaataggaacacttttacactgttggtgggagtataaattagttcaaccattgtggaagacagtgtagcaattcctcaaggatctagaaccagaaatgccatttgacccagcaatcctattactgggtatatacccaaaggattataaatcattctactataaagacacatgcacatgtatgtttactgctgcactatttacaatagcaaagacttggaaccaacccaaatgcccatcaatgatagaatggataaagaaaatgtggcatgtatacaccacggaatactatgcagacataaaaaaggatgagttcatgtcctttgcagggacatggatcaagctggaaaccatcattctcattctcagcaaattaacacaggaacagaaaaccaaacaccgcatgttctcactcataagtgagagttgaacaatgagaacttacgggcacagggagggaaacatcacacactggggcctgttagtggggtggggggcaaggggagggatagcattaggagaaataactaatgtagatgacgggttgatggatgcagcaaatcaccatggcacatgtatacctatataacaaacctacacgttctgcacatgtatcccaaaactttaagtataataataaaaaaaaaaagaattcttgcctcctgtccccgaaaccttggacttgatgagtttgatggccctactgtccaaggcagtaattcttataccaggaaacatggtcattttctgattcactggaagtagagactaactcctggcaatttaaatttatttatggccctgaaccaacagagatgagaaagtcactataactagctagggtaatcacacctaatgatcagggggaattgattttctgctacagaatgaagacaaggacagtgcttaaaactcagggaattcagtgggatgcctcttagtactcccttcccgatagtcctggtcaagggaaaatagcaacgatcccccaataaaaacaagactaccaagcactcagatcttaaagaaatgaagatttcaattgccctaactggaaaatgactcatccagtcaaggtgatgtcagacagtaaggtaaatacagaaggtattgtcgatgggggggccctataatgagcagtttaggcctcatgaccagctccagaagtgagctgcagctataattaatgttccttaattgcatcctcttctcccaatattttatatgaagagtgttgctggggaccaatattttagtcaggttgcagtattagtaaaagacatcatgggaatgatatggtagttgatgggattttgtgcataccctgtgttaggaacatgcatttgtcaaccacatggaggacaagattggaggttgatagagagaaaagtggtagagtattcaaggtatctttcatttctccctccagatccgctttccgctcttctttccccataagacctgcaggcactctatcaaaggccctcatgtccaggtgctcagcaggttccagacagtgagctctaacaaaattggagggaaggaggagtggggatcgggatatttattcccttggctccctccttgaaggttaacttaggctggctatgtccacaactaaagatcactgttccacgtacagtagctttctacacaaaactagctcctttcaagttctagagaaccttttttcttcccttttccctttggtcataggttgttgacagctccactgttactagcctcaggttactgccctgtggttcacctacactgtgctcagagttttacaaagtgtctctcccctatttattatttatccttatttgagtaggccatctctctctggaaaggatttgacatatccaaagtctaatgctcattccacaacacaatactatgaactatatatactgttaaataagttttcatgaaaaaagtaacaaaaggattacatagacatgaatatattaaaaagagttaaacgcattctgtaaacataaagttttgataggctttgctttcattactaggttttccagtgataaatgtttgtattttatagctggtgattacttggtccttctccttacctgaaaagtcagctaactaccaaaatgaagcttcacatgagaaaagagaaattatttatcctttaatgcatgtaaccaaatataattcaaatgcacttaccttccagtcattcagtttcaggtaaagctcaaaactatttccaaaactctctttgctaattaaaataaccattaacaagaaaataacaatttctagaaacctcgcaagttgtttcctgtctctccaatcctgtggaatgtgagtaaagttgttttggtctttagtagtttaattaataatcagttattttcagtttgggaccatagcatttttactgccttgaaaagaacaatttaggagaaacctgagaggttttcaagaaatctgctactttgccaatggaatctaaagtaaataatagttaaatatttatggttatcctaatggactatttataccactctaaaaggctgcttactgttgctacagatgaggatggcattaatgcactggtacattcaggacacaggatatcatttcttataaaaagcccataaaatgtacctccccgcctacacaactctcattcttactgcaacatcttaaagggattcaggaggcaccaggaaattgtttaaatttcaatgtaagttggagaaatcagttgctaggatccttaaaagtagtgtttccaaaatataggaatatctacactgatcagcctcaaggctttcagaataattcatatgagaaaacaggggtaggatgggatgccgtggagaaaccaaccccgtgcagcagctgcctgtcatgtcttaacatttgacatgaattacatcaagaactgaaatattcaagatcccactcaatatactccatgtgactcacctgcaaaaaaagagagactgctttctgtggcagagaagatctagaaacacacggtcaaggagcttagggaaagtggtaagaggcaaagaaatagatgagaagagagattagagccagtggtaactgcaaccaccatgacagaacaggcacttaggaccaagtgggggtgataaggaataggcaaggtgccaacagagagacaaatataaagctattctctgcaaggggcaactggcaccctggtttatatttcaatagttcagaaaaacagaggctgtctctactctgtacatggagcgtgagaagtaggagccacacaagataagggtaccaggaccacattccctctgaaagctgtcactgtgccactctaaagatgtgctgacccgtttaagaaaagaagaatcgggcatgaaatatacagaatacaccactggagcacagagcagtagtgataataatatttatagtaataacagagcctcctgccgcattctcactatgctcctggtactgtcctacgcattttacatataccatcgtttaatcttcacaactgccctatatagatattatccccattttacaaatgagggaactgaggtatagaaaggttaggtaaattaaccaaagtcatacctctagaaatgtgcagaaacaggatttgagcctccatgccaaagaagctaagcctgtgatccccaggagatacaggattttattttctgtgttgttggttcctgttcacccagaatgtagtagcactgtaggcactcagtgagtgtttgttgactaaataaatgtgtagtaatattaaaagtacatcttctctcatgacatgttcacaaatcattgtcccatgaagcatgtattccagtctttccaaagagcaaacacatggacatttatgcacaacatggaaaggatgtgcataaaaaaagttcattaatcaattccaaattggttcaccaatataacataaaattcagtgcagagatgcttttgttgtttgtttgccaattcttagctactgagagttgaagaactggattaaaatctcctggcaggacaagatgtttttttcctttttggccgagaatttagcgtttaatgggtgttcaataaatattatttttaattaaatggtgggggggggtgctgaattaagtagagaaatgaaatatcaaaatacatttcagtcaatggatctcagaggcttcctcctctattctagtgatcaaggcagttttttgtttgtttgtttgtttgttttgagacggagtcccactctgtcgtccaggctggaaggcagtgacgcaatcttggctcactgcaatttctgcctccccggttcaagcgattctcttgcctcagcctcccaagtagctgggactacaggtgcgtgccaccatgcctggctaattttttgtatttttagtagagacagggtttcaccgtgttagccgggatggtctcgatctcttgacctcatgatccacctgcctcagcctcccaaagtgctgggattacaggcgtgagccaccacacccagccctcaaggcagaagacttttattggcaaccatcttgcatctaactttgtggacttacatattttttcagaagatggtttggaaagggagggcataaaagtaagaatattagcaatgaaagcagataacctgttaaagatttattgtttgcaagatgcttttctaaatgcctgtgataagtacatcatcctgattacagaggaaataaatgaggacactggaagaagggacttgcccaaaacgacacagctagaaaatgggaaagtcaggatttgtgcccagactatttgactcctaagcctatgcaataagaggtcaagatactgctcaagagaattgagtttttcagatgaggaatttctgaattaagtagcttgttgctataaggtaagaaattattattttattgctgtttgccagtctccatcctggaaggtggagtacctccaggattcaagtacctctggttttgagtagaagacactgaactaatgtgctgaggtgttctgaggattgctaacacttcacacacaattaaaataatacttccaattgttgaggagaaaaaaaacaccatcctagagctttcaaatccactacatataatctactgtttacagattgcaaaaactgattgcaaaagacagttgttttcctgactgacccgttcttagtttataacatttaataaaatgtaattttggagccaatgtcttgtattattaacactgtttaagtgttagaacacaggaatgcttactttgaagaagaatttctatctagaatgttttccaatgtcattttatacaagcatccactgtgcctacctactctgttcatctttctgttcctaaaacccactgaactgtttcctaccatagagatttctcactggctgtttcctcagccataatattattctctcggatattcacatggatggttccttcttacaattctgattttaacttaaatgtgttctccttgaggaagtcatccctgaccacccacactaacatagtgacccagacatcatcatatcacattttaattccctgcaggacattttaaaatttatttttgtattttatgtgtataaatgtatggggtacaactataattttgttacatgtatagattgagtagtggtgatgtcagggtatccatcacccaaataaagtatattgtacccattaagtaatatcttatcatgcaccctcttccctcctgctcacccttctgaatctccattgtctatcattccatattctatgtccacatgtacacattagttagctcctacttataagtgcctgcatggcatttgtaactctatgatgttgggctgtgtgtcccactagaatgaaccagaatggcagagcgcatgaacattttctgtctagtttgtcatggaatttctaaggtgtagagcagagcttggcacttggcaggtgatcactgaatagatgagaagaaaataaatgatgaaatgaatgactgaataccatcttcctacgctttaatatagcatcactgatttaatgtatggaccaggatatcattcagaatataaaatgttgtcacaaaagtagcctgatatatcacagaggcccagtttaagattgccattattgttttaatataaaagttacatgattctgggattttgatcaaagtcacaaacactataaaaattacaaaaaaaatacagactatttttgcaaaagtgatgtttgtccagaaaagaatgtttgagattctactttctaaatggaaataatctctagatttgggtgtttgtttgcaacccaggaaactataatgatggctgatccctcacttattttttccaatatatattttgtaacctggtaatagaggaggatacactagaaagcataagaccagaggccggaatgtcttatggaaccctccaatgtaatctctattggtgtttcctctgctgctaaacgtttctgacttttatccactttcactaagttggtataaaggttcgataaagtcatgttcattaagcactttgatattcctaagtagaaagagattcagtaaaataaagtctgttcttttattttacttttaatgttctgatacctgataacaaataaaaagtaataataccttaatcacttcgaaaaagaattaggctcacacattggtctctctttctacttattaggattcaaaacttctataataatacttctaaataaattgagccaataattagcatggagagcaaagttaaaggcaggagaatgtcaccacttaatttaaataaatgaagagttattaattgaattgagagccttagaatgggactgaaattctctatctaagaagcagacatatagtagaatcaaatttcactacctaatcaatgccctaactctaacccttaatacttttattaagagtcagcacttaaattgttcttcaaatatcttcaattctttttttattcactaagattattagtgaagtattaatagttataaaagtgaaatttgttatctggaaatttacctcagacacaaaactgaatagatatgattgtagagacaaataaatattatagatgagggtgtgtgtgtgtgtgtgtgcatgtgtgtatgtgtgcatgagccagtctgctaattactatataatatagtaatgtcaacctcaaaaagcagtttggcaagaccacacttcatttacaggatgcattagctttggtatctttttgatttagaatccttactttgaatatatagaataaataaaatggaataataaaatgtagagtaaattctgcctctgcaagtgcttcttcaagggagatggatttcatttattacaataaaacaccttatggtttggcaaatctttcatcatgcaatccactgagtaaaagttactcaccaggtcttgattcagtattcccaaactgcagaatgcagcatgcaaagaatagagcacaatataaatatttttaaataagcaaatagcagaagccaaagaaaacaaagtggtctattttagtcatccaacaattatgaaatggacatcctttataaggcaatcttttaaaaagctgatgttaaagactgaccagcaatagaataagtatttaaatattccattgcttcccctggtttgccactgggctttccacacagtagaataagcaattctttctgatgagcagaataatttacttgaacctcatatattattggttcatttttcaagagaaaaatgtattggcattcattattaactttttttatcaatcagcatgcatgacagaacaacacagcaattcttcattacactaatggaggaaaaattaacttgacatcaagcctaattgactaaaacctcactaattcttctaaatagggataagtcctgcttgattagtgaaagcaatttagtatagaacatgtttagatagatgcacttttattgctttccagaacttaacactaacaaactgggctctccagcatcaaaggcgagataacggtagaggttcttcacaaaacctgccacagtgtatggataagactaacacaacatatcaaacacataataacaacttggaatttctctagataattgagaagctttaggtgcaatcttgccaaaaaaattgtttcaaaagaaatttttacagatgctgccaaaatactctatagccaagcccatagcaaaataaaacaaatcataaattatcagctatgacagactggtaatcaaaactaacaaggtttcactatgcgggcaatcctcaactcactacaagttgttttacaaaagttcatttgtaagctaattgttagaaatcataacttattacagcaatattctcattaggaaattagtatcatgtatatggagcaaacatgagcttgggatgcaagaccccagaaggggacctcagcatagttttgctgtttattatctgtgtgaacttgagggagtcactgtacttaactggatcttaatttatgcagctgtaagttgacttaataccaagttcatagtgctattgtaggaatttaatataataatagctaaaaagctaccccagtgccctctactcttacccatagccatttatgttcctttttcaagtatttctctatatcagagagtattggctggcaggtcatagaggagcatcagtgagttcatgaacccctttaaattgtatgcaaaatttggtaggtctgttgcaacaggtaatgggcttcatcaagcggctgtctaagggaatgattaaaaaccattgttctatagccactttcttgaatgtttcaaaattagaaaatgacaaatgtttaaaaacaatgactggaagcactctctgcacttaagttgctgttctgcccaactgtattatcccagtaaagtcttacatatctgtcaagatggatacaagcatgattttctcagaagagcatccttgaccatttcgctttcatcatgttccatcccaatatgcgccactccatttgcatcacgtcccaccccaaaacacaccacgtctctctcaacatagtaacttgcatatgcctctactctagtactcatcacactacacaataactattttttatgtcagtaagttctagttttatatgctcaaaaatttctagtcaaataaatatgaattttttcacaaaaataaatgtatacttagattttatttaaagtagccattttaatcgatgagaagcatacaaatcaggaagtaattttgcttttttaaaagaactctgagtgtaacaaatctaagttcaaatcgttactctgatgttaaacctccctgaaattcagctttcctatctgtacaatcaagataattacacctaaatgaatgttgcatatgaataatatttacaaagtatgggtatatttcttgcacgtgacaggtaccaccagcatcacaccaccaactaccaccattattatttctattagttattcaggagtgacaggtacaggcatacctctttttcctgcacttcactttattgtgcttctcagatattgtgatttttacaaattgaaggtttgttgcaaccctgcattgagcaagtctatcagcaccatttttctatcagcatgtgctcatttcatgcctctgtgccacattttggcaattctcacaatatttcaaactttttcattattattatatctattatggtgatctgtaatcagtgattttgatgttactattgtcattgttttgggacaccatgactgtgcccccataagatggcagacttaaccaattaatgttgtatgtgttctgactgctccggtgaccagccattcccccaatttcctcccttctgtagggcctctctattccctgagacacaagagaattgaaattatgctaactaataatcctaaaatggcctctatgtgatcaggtaaaaggagaattgcatgtctctcacttaaaatcaaaagatagaaatgattaaacttagtgaggaaaacatgtcaaaagccaagatagaccaaatctaggttttgtgtgccaaacagccaagctgtgaatgcaaaggagaacttcttgaaggaaattaaaagtgctactccaatgaacacacaaatgataggaaagcaaagcagcattattgctgacatgagtaaaatttgagtggtttggatagaagatcaaaccacccacaacataccctaaagtaggagcaagcccctcttttcaattctatgaaggctgagagaggtgacaaagctgaagaagaaaggttggaaggtagcagaattggttcattgggtttaagaaaagaagccatctctatgacatagaagtgccaagtgaagtagcaagttctgatggagaagttatccaggagatctaactaaaatcattgatgaaggtggcacactaaacaccaaattttcaatgttggtaaaacagccttctgttggaagaagatgccatccagggctttcatagctaaagagaagaagtcagtgcctggtttcaaagcttcaaaggacaggctgactctcttgtttggggttaatgcagctggtaactttaagttgagaccaatgatcatttaccattccaaaacttctagggcccttaataattgtgctaaatttactctgtctgtgctctagaaatgaaacaacacagcctggatggtaacacatctgtttacagcatggtttactgaatattttcagtccactgttgggacctacagctcagaaaaataaaagaaattcctttcaaaatattactgcttattgacagtgcatctagtcacctaagagctcttacggggatgtacaaggagatgaatgtcgttttcatgcctgccaacataacatccctcctgaagtccatgggtcaaggagtagttttgacttacaagtcatattatttaagaaatacattgtgtaagactgtagctgccatagtagtgattcctataatgaatctcagcaaaggaagttgaaaaccttctagaaaggattcatcaatctagatgccattaagaacatttatgattcatgggaggaggtcaaaatatccacatttacaggagttgggaagaagttgattccaaccttcatggataactttgaggtgttcaagaatccagtaaaggaagtcacggtaggtgtacgggaaatagcaagagaattacaatgagaagttaagcttgaagatggaagtgaattgctgcaatctcatgatcaaacttgaataaatgagcagttgcttctcatgaatgagcaaacaaagtggtttcttgaaacagaatctactgctggtatagatgctgtgaacaacgttgaaatgacaacaaaggatttagaatacttcataaatgtagttgacaaagcagtggtagaggttcagaggatggcatccaatgtggaaagaagttctactgtgggtaaaatgctgtcaaacagcatgttctcgcatgtacagagaaatctttcatgaaagaagcaatcgatgttgcaaacttcattgttttaaaatacttccacagtcactccaaacttcagcaaccaccaccctggtcagcagccgtcaacatcagaggcacggccctccacttacaaaaacattagaacttgctgaaagcttggatgatcagtagcactttttagcaataaggtatttttaaattaagatatcaatgtcattgtttagacataatgacagtgcacacttaatagactatagtgtagtgaaaacatatcttttatattcactgggaaaccagaaatcatgtgacctgctttattgtgatatttactttattgcagtggtctggaaccaaattcatctgattttgacaccgactatggttcagagaatatctgagcagggacagccttccaggaggtaaagaacataatgatgtttctggaacttcatacaaagaagcagactactttcatgtgatcacctggctcccagtgcactccagagtttcaaggcatactgttctccttgtctacaacagtgtgtgattctaactagatgggccaccactctgtatctcacagctgtgtagtacatggttgagtttgtaggtgtgaagaaggtaaacgtcaacaatttggcccctgaaaatgaggacactggctcagggctgaggattctgactttctactcagcaatgtattatcatcgctagtcaacgtgaaccacattaagagagagcctattaaaagcctttcccacttttccccaaccccacagtccttcattactacttcccacctgcctgaaattgagaacatctaactcacaatccacccacaaacactttctccaccttccatcccatcttagaataagaacccttttccttttcattgtgaacagctccacttgtactctattttcattttttctctagaaatgtgctccataagatatccctaccatgacttccattctcttttgaacgttcaacctctccctgtctgcctggcctttcctctctgtcttaaatctaacacaatcccaaatcctgatactccactgaactgctcttctccctcatttttttttcacttcaatgacaaactccttaaaatagtttacttttctagtcttttcctatatctctttaccagatccagcctttcctcttctttcagctacttgcagcaaaataatgttccccagagtagctacatgtaactttagaagcattgaaaatgtatgcattctttgccaaagccttttctaaaccaaggaatgagttattcagcacacacacacacaccacacagcaacacgtcctaaatacactttggacctctcaccttacccacagagtttctgctgtccatggcagatcttcccaatctcctctttcttgaaaattattccaaaatgttctctccctaccccacaccagttctctatcttcagataaacatactatggaagatgatctattattctcattcgtctgagccagggcaatgcaaacaaagacacaccttctcaaagaaggtccaatatactagggtccacaggggttcctgtattcacagctaaaaatataccaccactccattccactctggcccctggtcattttcttctgtttcttctgttttttctttgttatgcccctaaggatgggatggcctagcacatgggactttgtccatcaagctctcttctaatgaacctgacaccaggaaatgtgttctcaggaagaagcaaagcatcaaaattcaatccatcaacagacaaatggacaaagaaaatgtggtatcaacacacaagagaatactatgcagcctttaaaaagaaggaaatcctgtcatttccttctttttaaaggctgcatattttaaaacctgggaggatactaagccaggcacagaaataaatactgcatgatttcattttcacatggaatctaaaaaagttgagctcataaaaacaaagtagaatgtttgataccagaggcctggggactgggaggaggagagatgttggtcaaaagggacagagttatacttagaaaggaaaaataagatttagagctctattacacagcatagtgaccatagttaatgatagcataatgtatagttcaaaactgcttttaaaaaagtagactttacatgctttcacaacaaaacaaatgaaaaataggtgaagtgatgaatatgttaataagtttaatttcatctttctacaatgtgtacatatattaaaacataacattataccctataaatatatgcaattattatttgtcaatttaattaattaacttctaaaaattcaatccaactgcctttatagcctttgctcaaacttgctatttgattttgttctctgcaaactgccatggaggccctgttctcttagtctattctggaagccctcatatatatcactcttggctataaattgctcttacatgaactaatccatctacttttgaatcttcaaaatgatccccattatgtcttcaagaaaccccactgcataaaatgctttcctccttccagttgataagtgcttataaatctggcatatgattcgatgactttgaaccaagtctcctactctttcaacagttgctcaatattccgtcattgaaatagaggactttgtggctttgcatctatacataatgttagatgctgtttctcttacttaatccccatcaccctcacttctcaggagcatgatggtgatgtatggttgtatggtagacacagaaataataagatttagtatttaatgcatacctactcttagtcataactttaaaaatatttcatttaatcctcataataatcctgccttgtagatattattgccagtttacagatgaagaaagtgagttttagaagttgaagaaacccgattagttatcagagtcagatttaaactcaaatctacctgactcaagtacttttgacaaagataagttgcactaatgttcatgttactaattaacacctaatgaacaatgtataattcaaaaatgacacaaattttgtgagaaaatataattattcactcatttaatttttcactctgctttaagcctccctaattctaaaagtagaaaaatcagccaagtacagattacctatatttagctgtaatatagaaaaagaaaaaagttgcaatgaaattcaacactgagaaaaatgtttcttaatctaattaaggctatttaaaagaaaaagaaaactaaagaaagcaacctactgagcttagaagcattcctattaaagttggaaacaagacaaattaccaactatcaccacttctactcaacattgtcctacgagcccttgccaataaaacaagagaaataagagttaaaacaattagaaaacaaattaaaaagggcttctttgctcttcaatatggatgcagaaagtccaaaagaataaacaaacaaaacaatactgggagaattcagcactactgcaggacgcaaaaccagtgtactaaaatcagtgtactcttacatagcagtaataatcaactagaaaacagtaggaaaaaagttatcatttgtgatacctgtggagctacaaagtaattaggaagaaatctaacagaatattttaaaaatatttctaatatagtaaattaccaaaccaaaaaatcttaaatatcataaaaatgtaagctgcagcctagttaatctctaaattcaatgcaatgtcaatgaaaatctccacaatgatattgatatggaaaaacaaagacaacttttagtgaaaaaacaaggtgaggagcagaccttgtctttatagctgactaaaaactataataattatggcagtgtggtggtaggtcagagttttgttttttttttccaaatagacaagtgaaagagactagaaagccaaaatacagatacattaatacatacaaacttgatacacggcaggaataaaatgatctgttcagcaaaagaagcgaggataactgcttatttatacaggaaaaaactggatcctcatatacaaaaataaattaaacttaaaatttttgaaagaaaatatggaaggaaatcttagtgaaaagagaaaccacagatttggagaatacatttataaatcatttaatcaaggaaaattaacatccagaatatatgtaaaactcctacaaatgacagactctttcttagaccaaatttcagttaggctcctctgaggtctcttctcaaccagaccttcgacttctgtgtccatttttgcagaattcagtcatagcaagaatcctgccaagtcagtttagcaagaatcccctcatcctttatatatgatcactcttaatatctgatcaaattcctcattccctctgactcagggaaaaatcaaataattatttttaaaaaattcttcattctccaccatccccaaagtgatatataatcaccctggcctgccttcagcaagaattccattaaattggtttagtaggaatccccctacccttgatgttttctcttaagaatattccatgcattcttcccctctctctgctaattggctataaatgccaacctgtctttactttatttagagttgaacccaatctctctccgctgttgccatagaagcaacccttattgcaacagtcttgaatacactcttccttactgttttaacaagtgtcagaatagttttttctttaacacaaatcattaagaaaaaaaaactcaactaaaaatgtgcaaaacagatgaataggaaacataaaagtaaacttatgaccaaaacgcatatgaaaagatgctcaactgcactataatcagaaagacaaatcagaaaaagataccacttcagacttattaaattggcaataatctttttaagtctgaaatttccaagtattgctaaagacaaagagaaaacaggaattattttttgctgttcatgagaaggtaaacaaacataagaggctggaaagcattttgttgttattcagcaaaattaaatgtgtgcatactccatgacccatttttacacatctatttattagataataatatatatgtatatgatacatattaatatataatataaaactttatatatgtgtttatatgtgtatatatgtaaatatatatattatatatatgtatataaaaaactattcacagagggaaaagaaaaacctaaaagtctacagattatctccagaactcaaaacttcataacattggaattgtgtttgcatggacctgaaagcacattccaaaggattaaaattataaactccacaaaaatgctgactatttaaatgtttatcacacaattaatgagaatgttatcttttcatatggatatcaaagtagtccatgactgacacccataagaaactgactgttctccaaacagagtaaatagtacagatttttgtacctttaaaagcacattcatacctaatcttatttgattatactagctgacctaagagttggcaatatcaacattttgtttgtttgtttaagatagggtctcactgttgcccaggctggtcttcaactcctggactctggtcttcagctcctggactcaagtgatccacctgccttggcctctcaaagtgctggaattacaggcatgagccaacagtgcctggcccaatgtttgttttattttttaatgaactttctgtgtaaatgttgatgccaccagcctccacaagaatggaatatactagctggccaaatgattagctaacataaggaaccagaacagataaccctagatccctcctgacattagctatcaaataaaatgcttttgtcaaatttacataacttggacaagcttttatctggggaaaagcaagtagttcttaatgtagtgttttccttccttggcaagtggctctagctggtatttcaaggctctaacagagaatcggtggtgcaaagcctgataaatcgtcatttgaatagcaaattatattggactttaagattctcttccattaagagagagtaaatgttccaaattctcttaatttatctgacaggtcaaaggcaggcttgtgggcatttatattcagaaggttgtctttattactaaattacctatgagcttttaaagtccagctttactttctagaaaatctactcaaattttaaggtagataagaaaaatgagaaagaatggaattctgtatattttaccttctcattttgttaccctaacctagaaggaacatatacaaatagattcaaacagctatgtggtttattacaagaagtcatctttttaagtgatgatctttacataattaagcatatggatttagaagctattcccaaaggtgcaaaagatgaagtgatgcgacttgatgactatgataaaaactaagaaaagacaaaaatggtaaatggaagagggagggagatgtatatttatcacaagtgtacaatgtattagacacaatgttgcatagttgacccataagaaattatttcactttcacaaaaatcagtaaattaagaatctttgctcctcatttaacagatgagcaaaggctcaaaggtgttaattattttttcccaaatcaaacaacatattttaatcctaagatgcaaacaatggcctgtgtaattccaaagcctatgcttctcttccacatccaactgccttgcaagaaaaggagactcagaagaagcaccaggaaagtattacagcagctaaaatggtgacagagcaaggatggtatcatgttaccaagaccacctcataagtaactcaacagggaggggaggggctccagcgaaaaacctgcctttatatttctagcatttagcccacaataggtactcacttacgtgttaaactataggaatggctcaggaagaaagagtgaatgaggattaggaacatagcttgtggcccacgcctgtagtcctaattactctgaaggcggagtgggagcattgcttgagcccaggtgtctgaggttacaatgaccctgtctcaaaaaaaatgaataatttaatttaattttaaaaagaggaatatcacatgctgcctagaacaaccacttacattattctaaaaatgttcagagaataggtagtgagtttagaaactgtacatgattaagcatgtacggagatgatgaggaaggctggttaacaaatggaaacaataggcagcgtagtgtaaggtaagttaaccaaacagaccaggaaacaggattcctgcacttcaatcctaatgtggtacctgtgtgaccttgggtaagttccttaccttctctgtacatcagtttccaaatctgcaagatggaaataataatcgtacttgcctcacagggttgttactgtgaagattaaacgagttaatatatgtaaagcatttaagaatatgtctaacatatatagtcttatttcagaattagccaatctttagaaaagttggacagttgtgggaaagaaggtttgagaaaacttgggagtagcagattgaggaaaaaaataacaccttgaggtagaaaagatggaacttgtttgtagacacgggaaaaggagagattcaggaaagataaatgaaaacaggccagatgtggtggctcacacctgtaatcccaatactttgggaggctaaggcagtaagatcacttgagacctggagttcaagatcagcctgggcaacatagcaagaccccatttctacacaaaaaaaatttagttagccaggcatggtggcatgtgcctgcagtctcagctacttgggaggctgaggtgggaggatcccttgaggctaaggagtttgagatttcagtgagctctgattaagccctgcactccagcctgggttatggagtgagaccctgtcctaaaacaacaaaacaaaacaaaactggaagaggccacaggaaagatgagaatatttagaggaactggccttaaaaaggagaaaggacaccagttctggcacaaaggggacagtggagagaagatgaggacccagagtagtttttttaagaagtaacagaagtaatgaggtgagacagcagagttcacacattccaaatcatcatctcagtctccttgttaaagtaagaaaataagaaataagaattttgtggagtaataaaaaaaaaactttagaacagtttttcatgaataaaagtatacttcatatcagtgaaagtaggctaaattcagtggattcaggtaccaattttcatgaccttagcaacacatagagtaaagccagataaaatgacctgtccagggcagggatgctctgagatagacccagtgagagagaaattccactaacagcaaagacaacccagaatttctcctcatgattggctatatcatctgcctctagttactgtttttatgtaagtaccagtcaatcaagatcagtggaaatcatttcttatgtcattttattatttgtatagttttctattttaattaattgttattataggggaaattaactaatttctgtttttaaatcttgtgatgttcaagaactatatgatttaaaatagtaaatggtcttttagtgaaatagtgcagaccagatatacatatttatctctagtccatcctgaaatgccctcttgaagctatgtccttataaaggaataaagacataaaactgcaaggacaggaggaaagagagacaacatgacagcattgagatttgtattttggaagatggaaagaggaaggcaagttctgactgacttcacaaagaaagtcaacaagaagcaaagtgatgcaggacccagaacctcaaaaaagttcagggattagaggcaccaagtacttctgaaggcagagggcaaagaccggaactaaacataagagaagtggctgcaagtctatttagggaacaagtagaacctcaagtccttcctcccaagccaatgtggcaaggcagccaccccaaatgatgactggagatctacccctggggaaagtgaactagagagaccctcaattcaaagacacaaagcaaactgaagacagttgggaagtacagtactaaagaaaggggtgttatgtcaaatattcttagtgccccagtccccttctcctcccactccacttcccaagtgatagccagtaatattctacccttcttcccaccgccaggcaagaatggagaaaaacacaccacccaaaagactggtagacaagccccatgcatatatgtacacacagaacttccagtcagttttttttgtatttcatacttaaaaaaaaaaaaagagtgctttccatttttctgtgcaaaatgtgtaatatttcagttatgttatggaagggtggaaagtttggaatctgtgaactctgctgtctcacctcatctgttacttcttgaaaactgctctgggtcctcatctcctctccactgtgccctatgtgccagcacttagaataatgccaagtatatgttaagtactggaaaaatacttgttgaatgaattatgtgtatttaaactctcatggaggcccaaccacctcaaaaatgttagcattctattcatagagtgtcacttcatatcagtcatcaacaaagaaaatctccctaacatctccacactttgcagctaaattctattttattgcacctcaactttacacataaaattcacaataatcaacttctaaaaatcactttatatttaatagtatctattcttaaatgaaagcacaggaaatttcataaaaagagagactgatgacagattgctggaggaacgagctccagggtccctctagtggccttgaagagctgacaccctccccaaagtaccaaacattcctcagcaatcaacatccaacaaacaccaaggctgtgtctgggctggggagccccacccggctgcagagatagtgaaatgactccacacttggctacacaggaacgtcgaagagaaaaacacaaagcatgtcacaaggtgacatgtgacacattacctagtaacaataactgaataactggggaaatagcatcttgtgcacccctctttttcctacatcttcctttttacccctctgtgacccccacttttccccaaaaagcatgcacgtgcccacacgcatgccacatagactgttgtgcctcacacttagtaggcctggagcaaaggtattaaggaactctcaaatcatttcgtctaaatatttaaaagttataatcaagctaactgttaaatgttaatatcttctattatttcactgtgataaatatgcttccatgaaaacaaaataaaaacatatgtgtaaaactatgatttttatatgactaaacacagataaaacaccagagacttctaaatttaaatattattgcttagctgagtattctgtaatgagccagaattgcttggatgaataataaagacattcctaagtcatacagtttaagtattctataacatgtctttgttctttctacatttcagcaagatcaaaaattatgcttttataatctagattttcacataatttacattctattgacagtaatgccaattagaccacctttcttaactcactgtaatttttagagagttccttattattttcaatttggaaaaactttgttgaagcagtgacagccgggattgtcaacaaaattcttaaatccatacttgtaactcaaattgaaccctgagttatattatcatgttcaatccttttaatggggtcacctaggttagattatttttataatataaaatattagaaagtattttaattttattattaaaatcactatcacttatattgtaatacttactctcttaaagcaatatccagacctacttatttcttaaatttcatttcttttgattttttgtgcaatgtaaacaaaactgaaaattgcagtctgttgctcaatttgtttaaatgtctatttatttgagactataccttcaaccaaaatagcgagaaaatagtccccataagaaattaacgtcaaaactattatctcaaggcctggtgcagggctgtcaccctggcacgcaccttctcttctttcttcagctgccttcttattcctggaagtgtatttccagaatcttagttccattattccctctcactagataggtagtttacctaggtttataattccacagttgttttcattcagaatattgaaggaattgtgccactgctctccagcattgatgtggggaagtccactaccattcagcttccaggtcccttgtgtgtgacctgtttgattattctcaaagtctttagcatattttcttccccgatatttgcatgactggttctttctcattatacaattccctactgacaccttgagggaccttttctgaacagtcaatcaaaagaagctcccacacatcactctcacatcaccatgctttagtttcatcaaggtaggttattactatatgatattttcttgttttgctcatttctatattttatgtttccattgaataaactgtaagctcctcaagaatttgcttctgaatttccagtgcctaggacaatgaacaggaactcaataaatgtttattgaataagtaaatgaaagcattactgtcataagtggaataaaaacagccttctgattttatttcaaaattatgtaaaacaggatcatgtcgagggcctcatctttgtcatggtgcttagatttactgcaaacatgtcttctgcccatagctaatcctaaatcaggagccttaaatctttaactaaaatataactttggagaagttaaacttatttgttaattatgatttaaaaaaataatttagcctctcacaaaagctgaaggctttgacagccatcctcctttctaaatataaatatgcctatcagctcattctgatactcaaggcacatttagcagctagtttatcctagtaggttcatcagaaggaactttcctgaaatcaggagaggtcacactgagtttctagtatggtcaaggaggtgatcagccctttaaatattttaaatctcaaactgtatctcttccgtgctttgtgttacaggacttgaggatcccaggggagaacttgttcaaggttggaccaggttcaaagctccttctctgtagaagtgtagccctgcctaaagttatcttgttaacgctggaaagatacaggaaaatcttccatcagagcaagaattcaagttaggctccaaatttcatggcagattatccctctgccatctggtatctaaagaattattaatcaatgtttaaattagcaatatagctgactggcacctcttgaatgacttgtcagagttcaaccacaatctcactataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccagcaaagtatataagaacacaggcttcggtataaggcagccttggtactaatccaagctttgccattaggaactgagcatctttgggtttgctatttaacctctctaagtcatactctcctaattacaacagcacttgccccctaggttattaggaagatcaaatgaagtaattcatctaacgttctaggcatagtccttgagcatttaatgaatgttaattgtaattattattgtaagaaattatatacttgaacatttccagattctttgcaaactcttggctgaaagcatcattcattacactgcaaaaaataatttcctcttagctgagtgctaacacagaactggctcttcaaatacacttgagattttccttaatcaggtggagagaagcatatgaccaatcatgttttctttccagaaggaaactcaggtatttgccataataatctcttccagattgctctattttttttgctttttttccccttaactggctttcctttttattttgtttttagctgttcacttttatatcatgtttaactatatagcttgtggatctgccattcactagctgagtaaacctggaggggttatttaacatctaaagttccactttcttcatctgtcaaatgagaattgttgtagacaccagtgatactatcttttcagcatccctttttgataaccactcctctactccatccacattcccttgataccattaaaggggcccagccctctaagcacttagattagtctagaagtgatcatctaattcaagctgaaccaggaagacacttgccagagattttggatttaggactgaaagagtcaggtcaatttccttctagtagctgaaattataagacaaacctcaggaactgctagtggctatgtatcccacttatggaaaagatagcctacagtgaaagaaaagaatgatactaagagacaggaaagagaaggagggagagtcctaggggttctaatgtttcctaggttcttgtttttcctgtagcttggctgttctattagtcatctagtatctttccagtaagttgtcctttgtgcatatataattttgtttgatttctatcacttgaaaccaatatagttctaatacataagaaataatccctacactgagtagttgttataaaaagtaaatgagatcaaataattaagtgctaagcatattacctggtatatgatacgtgctcaagaaattgtgcctattaatattatttagaagatgtggatataaatataaattataagtcagacaattaataaaaacaattttaataatttgcaaatcttcttgcaatttcaaaatcaatcaaaggattatttgattctggatcttcaaagaattgtaaaataaatgctctgaataaattttgctatataatattgtataaatgcaattgagagactctcatatagtaaataatcttagagaataatgaagtccagaacagtgatccacaatttctttcttaactcacttgtttagagtaaacatatacagggaaggtggaaaaacaatgcagacttacattccagttaccccacatatataggaataagtctgacatacataaatgtacaaaaactgacttagctgcataaacagtcatgtttacacagtataaagaatgcagtataatgaaggaaaaatggaattaacatatacctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctatatgggaacaaaaaccaaagagattataagaagaaaaaagatgattcatacagacaaggaaatagagtttactgctttttatttataagaggaaaattgtatgtctattctatgtgtaaagaagtatttttagatatataaaatttctcttttttacatgtattttcatttattagattctgctgttactgtttgttcgtgttagaacacgtatacactcttattttgatgaatatgaatagaatatgaattatgcacatctgttattcaatattaaattgctgatacttgaaaaaaaacaaaaataacctccaaattttacaacatgaatcaagtatttatcttatacttgtcaatatattgactctttgttctccttaaactcacaagcctaataactggaccattctcataattctaaaaataaaatttctgtctttatttgcctatataaagtagctttagggggtaaaatattggatgttttaaataaagtccatttacctgaccatatgtctttaataacatctttagcattctttcaaaaaagaaaagtaggtaaaatccaccaaacacagcaactgccttctcaacataactgtcgactttgggatcaaatccaaatgcctaagggagaaaaaagggcaattcaagtaaaaccaagaaatttaacttgatttctggaaaataataccagtatgcaattctcaccaatgttctaagtctctcttcacatccaagtaatattggaaacttagctgccaaaaatcacaaaacaaaaactttgaaatttgaatgacaaaactgtatgagatggcacaaaaaccttacaactagaagtctcattaaataaagccaccagagaatcttacagtttcccacctataacacctacagcaatatttgccttgaaagagtaaacttttagcagtaaagcagcagctctgattctcatctttagaatacgatattaggtctagataatgaagataaatgagatattgattacctactgtctctaaaagtaatatattagtccatgatatccagaatcaaacttttaaaacaaatatggcaggccacttggattactgttttcccaagagaaatcctcttatacctacagaactgtgataaatcctaaaaaggtaaataaatcaaggcctaggcccaagaataaaagcaaaaagaagatttaaaattgccaccactctctctctctctttcacacacacacagcaataagaatggaataattctttctttaaaggacaaagaactggagttagagtttgaagttataaagagtcaagatgttcctaacagacaagacacataaacttcaaataaatagaatcagaggagagactaatgggtgaaaagccacaactttacaccattccacacattgtaaatctcccctctgaagcagaatagaagatgtctgggttcttgtcctatgtttgcctctggggagacatcatggccgcatcctcatttgaataacttctttgtgcctgtttatacaatgcaaaatggctatataaatataaatgttccatttacctaacattgaggttatgaaaataaagtgaaataagaaaaggaaaatcattttgctacaaaaaactctatgaaaatttgagagattattacaaagacagattctttatattgttaaacttcaagaaaatagaaaaccttaacatcatcaatgtagagtctttagtccacatacagtattagtttgtttaatttactttgacccataaagcagatgagataataaatacatatattatatcatattaaatgtattatgtatataatactcttttaaatcagaaaatctgtattgtcatcctagctttgttactagctgattgtaaggctataatcaaattatttaaccaccctaaattttaatattttttatctctacaattgaggctgtgaaatagatattatcttaggtcctagatcaaataatgataataaatctataactctaaaaagttatatacccactttcaatgtatagcttgaaaaattaaaggaagctttagttataattttctaaaaattacgagataagggtggtactccctgaaatactattaatattttctctctgtatggggtttgtctctccctgtgtgtgtgcattgtgggtggcagatacagtccatgtatacatatatttctctagttcccctttgtggatcccttctatgaaagtctctttctcctttccttcctcttcaacattgcctctcttttcctttcatttatttcccttcctccatttctcttccttatatgggcacaacacagatttgaaataaattgaatagtgtgcactatagtcaagatagatcaataacacattttatcaaagaaaaaaaataagttgctatttatttattagtcctcaattgatattttttccacagttggaaaaaatgaaaaggtttgtcaaccatgctctcatttactctctagtcacttataactgtagtaaatatatgagggaatttagtggtatatgttaaatacattataaatttacatttgacatttgcagtacagttgacattgcatgctctttagaaaaataaataaataaataaataatgaaacagtgtgtggaaaaattaaatttgccaagtgcaaggcagaataaagttttaaggccttctgaggtgtcccagagctgtctgagcacgtcctagtggctggcctcctagaatattaattttgtctctgatagtgatatccactgcagcttgggacaagcctttacaattgctgtgattcagctttctcttatccaagacactataaactagaccataaaacgctgtaagaattatggaggctaaaaacatacaaagtgctaaaacgttcaaaagaaacaattattcacagaaacaaatagccaacatccttacctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaactgtgggtcagagggaaaagagagtagaaattaatcagagcaaggaaccaaatgatgttttcctgtacattaagcttaaaagtgtctttaaaagcttaagacacatatcttctttaaaagaacaaaatctactcaatgaaaagtatatagaaaactgagaatacaaatatggcatagcaagcattaatagtaatactgtttatgttttaatcagccctaaatcatcattatgggattaatgagttttacagcttgcagggaaattggagaacatctagaacagcgaacagcgacaaacaatctgagatccacaggctccaagccacctagtttcatctatggctcaaggaatagattaaaacagcattttgaaaaaaaagaaaaaacaggggcagtgtgagcctcaggacaaaggtatggggtgatgggtgggagggcagggatggagatgggtcacagtgagctagcttcaaggtgaccatagctgctaacactgagtttgtcacaatcatttgtcttcagactcctgaggacagcatctcctcagagaaggtggcaccagcagcacctcaggtccccagctggagcctcctgggaatcaaagtcagtctgatgcaataagcactcaggaagtgagcacatggggcaggagggagcagctgcattacataacccaccctgtgagacacaaattaggcaaaaatattccatacagaagagatgctggtgacagaaaaaggtggtgcatctttcatctctggagacccagggcctggcacccagtaggcacacaataagtattgcttagaataaaatgaatgaatactatcctaagctctatagctaatggcatgtgtgacctattgcctttgggcctcaatttccctctctctatcttaaaggggctggtgtaaggacaaaatgggaacacaagtgaaacatacccaggacagtcacctatgtgtgggtgcaggctgagatacaacgtggcctcagggctgtgcaacatgtgactttgcctctggccccacacactgtacacaaagtacagtgtgacagaggagaaagctgcctctgcatagccacttctttaaaatatccagaaagcatgtttaaatggtgggccacttttctccatggcactgtcagtggagtacactagtaacacctacagctcagggagcatttgccatgtgccaggccctgtgctaagtgatcaacatatgtcaacttatttgaacctcacaaaaccctgtaagagaaatactactacctccttcatacagttggggaaaccaaagcagatggaattcaagtaacctgccagaatcacgcagatagaaagctggattttgaacctggacagtctggctcccaggcccacattttttagcatatgctttattattcctttagagataatctcatttttcaaaagcccaaaggactcaataaaactgtaaaaatgttttcctgaattatacatactttattaacacgagattgttcactataattattgttagtctagaatttctatgtacaaataaacaaacttagtaaatgttcattcagcctagatgacgtggaccaaaccatggctcctgccaccacacacacacaaacacacacaagtgcaaacacacacacagagtgatacaaagtcacctgtgctaagtaccaaatgaaaaggtcagattataaatggtactatgtaaccccgagaatcatcacagcactgaccatgacgactgcatcttctccagacactttcctatcagttgcaggtcctggccatgccctacaacttcacctaacagcccacttcattcccatttattaccttatcaccttaaacaatactactagtccccacagacattccacttggagagagttctcaattccacaccttttatcgtggtagatctacatggaatttctcttaacacaaacatacttctatccatcactagcctacatgccttcattcattcaacaaatatttataatctcattgggtagacaagatatatacatgttgaaaactaaaattaaaaggcaaagaaattgttaagtgccaatagaagcaaagccacatgcacatgttaaactcatcagcttccctgcaaacacctgttccattacccttgttcactacctacataaataacaggaacagtaggatcaatttcagtttttcactttccaccaattaattccatagacaactggtgatcaaaccctaccagttctgcttcaggcatctctcacctctagcctctccatcctcattgccagtggtcttgaagtcagaccctcatcacctctcactccctcatcttatataacatgacagttatcgatctggtgcccctcctactagctgacatggcctacagacttatactaaatcacaaaagtgatcatctcatgcccccatttgaaatcgcccctcataaactgacccttgcacagcctctccagtgttatttacccccttctcaacatggcctttacccaaacactatgttttcccaaccgagctttacctttacactgtggttctctgtctgaaaacactttcctatcttccttgcctaagaaagtcatacgtggccttccaagccaacacaaagatctcctctatgaagcttccctgctctccaggcagtactccctggctggtcaggattcccattactctttgttcacttaccacttcttgtgtgctacagtaattttatcactgatatatttgcctacatcatataaactgtgtgattctcaatgagaagggctatgttttattcatcctcagtgcctagaaaattgtccacgaaaaagcacacattccttgctgaatgaattgataaattccccatttcaaggtgcagcagaactctgtcaaaaagaaataccaatcgatctgcttatccaactttctaactttctttgcccttgcacatttatcagcacaacttgggggatggtgggagtgtaattcatcacattctaagcacactgcatagcttccccttcttgtattgttagaacatcattcagaaaaaaatgtctggagtttccattcaactgaagcactttccacttaactgaagcaccaaaagtatacattagtatgaatctattccttggacatctccatatatacgtgggactttctcaaacgatctgtttcagagagggaccagtctccttataagtgaaccctgaaagattttaatagatttcaaagaaatacagtcaggatagtttacatttattgactgtccactgtgtaagattcttctaagaactttacctattttaactcatttaattctcacaacaaccctatgagataggtgctgctatttttcccattttaatagtgaggaaatatggttctattatgatacccattttgcagacctgcatacagcccaggcttcaatttttgcctggccccatttaactgtgaaactgtatagaatggtgtttaacagtgtgaactctggagccagaggatttgtgttcaaatcccagctcatcccctcactggcatcataggttggttccttgacttccctaagtttcagttttctcatatttaaaatgcagattaaaatagctcctatttcatagagttattacaagaataaaataaaaccagttaatgctgtccctggaatatagcaagcctttaataaatgttgattacaattatgtttaaaaaattagtaagtagaccatgatataaatgttagttcatttaattcactgttactcagtgaaaagaagaacaaactaagaatcaggagctctcatttcaccttaggtacgacacctacaagaagccacttaacctctctggaacttggacttacatcactagttgtattacagagttggacaatatgatctccaaggatgcttcaattaatattctttattttatctactatatgaattaaatatgattctgcaacttcatcaaaaagtgaggcaatttcagaccattaaattattactaaaatgcaattaatttctctcctagagaatttaacttatcatcagtttactgtactcatcaatatcattttataaagcacatgaaatactttcaaaaataaaatgtgaggcctctgagaaattttactgtctacccactgaaatgtcaacataaatgtattcaaatttttgtatcatttggattgtttttatgttgattttttattgctttggatgagctaaagacttgactcttcattaagtgaaaagttatatgaaaaatccagtgcatttaattattttaaaatgtttttcttagtgagaaaaacaataggataacacaggggccagggaatgtggtgaacctatgaacacatgtataagaacaaagacattcttcttcctctgtgccaggcattgttctaggcacttacgtatattaactcatttgatactcccaacaattctataaaggtactattaaagtaactgacccatagagatattaaataatcatacagctgcactaaaataaaacaatcaagatatcacatcaaaaaggcaatagagtgccaagttaaacatcttagatgagtagtaacaagcactctactagtttccctaaattcccctggaaacatttccatatcttctccccccgatcccactccactccagcctcatttcaattcctaagacaatatgcaccctaagaggcatttctctttttattgggttatctgtctgaatatttggtgatcccataacttagaattgctgacttttccattttatgactttgtagtgttgtccctagaattctacctctcacaccctgcttctgacttcccagttctcaactcctggttcctgaaacagagtaacctagtcaactggggtttaaaaattacttttgaatatgagtaattaacttgcacagagcaactggggttaaaaaattacttttgaatataagtaagtaacctgcacagagtagagtatttgctttttctgaaacctcacttcctgtacctagagttatgcacgttagatgtagttatttaacagacctaactaacaggcctaccacagcacctaggtactgaataatgttcgaagtactttacaaatattaagtcatttaatctttacagcaagcccataagaaaggtactattttagatgaggaagctgaggcaggaaaaggttaaagtcatgttctcaacatagctggaaaattacagagctgggatttgagcccaggtaaactggcttcagagtctgtgcttttactgtgcaatactattagtcaagggtagtatcctaaagcgtttgctgaatttactttttaatgtaaagtgcaaactgtattaaacaggcttgtagaaatataaatatactctagcaaaaatatttgcttgaacaattagcaattcaaaattactaatatttcaaaattgaaattactgttattcacaaaattgcaaattatattgataaatgatacttggtgatttctatgctttgtatatataaatacagaatatcaatgagaacatgggttctgaagccaagacaacctgggctgaatctggctctaccacatgcaagttgtgtaactttgagcaaatgactttaaactccctgtacctttgttttcttggctgtaaaatgggaatagtagtgtctacatcatatagttgcatgaaattaatatatgaatatgtaaagtacttcaaagagtgcctgtcatatagtaagtaccacaaaagaattggctatcatcattgttatttttgtcattgttgttgttatttcttttattcatatagagggagactgaagtgtacatgcacaaaggaatccggaaatgaaaacaggcactttctttgttaagtcttcccttttcttctctatctttactctctttatctatctatactcctgtcagatgagctcactcagaacagcatctttatttttatttttttgagatgaggtctccctctgccacccaggctggagtacagtggggtaatcataggtcactgcagccttgacctcctatgttcaagtgatcctcctgcctcagcctcccaagtagctaggcctacaggtgcatgccaccatgtcagctaattcttttaacttttgttgtgatggggtctcactatgtttcccaggctggtgttgaactcctggcctcaagcaatcctctgccttggcctcccaaagtgctgggattacagggatgagtcaccgtgcctagccccagtgtctttaaatatcatctctagactggcaaatccccagtcttgacctctcctctgaaagcaatctcctctccaaatgtctgtgtgcctttgcctactggacctccctgtctacctgtgtatgtcaatgtctcaaagcaaccacgccaaaaattatattctttatcctcaccactcccttcctctacaataaagggctcttcccagtcttctccatcccgggaaatggtataacgatctctccggtttctctggctcaagacttgactcattgttccctctcccacaatcaatccagggcaaaccatttagcatgatctccaggactcatcccgaatctactgcttctccccacttctacttcccccactttagtccaagtccccatcatcctggcatcagctcctggcaatcgcttcctgaccaatcaccctgcttctactcttgccccattacaatctgttcttcagattgtaggcaggtggaatgcccttttaacagatttgaatgagatcacagcattcccctgtttagaatggtacagtgacttcacactacattcagaataaaacccaatcaatttaccacctcccgcaaggcttcctcacctggtctccatctcccgccaggacatatatccttctaccttccccaccaactcactaggctccagacacataggagcctcttgctgctcctcactcatgccaagctcattgccaagctatgttggctgtgccctcaatcaagaatgctcttcactagagacgaccttgctgtggccctctccttctgctcagatgatacctcatcagagagggcttccttgatctatctaagatgacactcacccactatcaccttctatccctcacctactaatattttattttcttcatagcacctttcactctgaaactatgttgtttatttgcttgtttaaatttgcttgtttaaatcttctccactacactgtaagccctaaaaagacagataattattcttcttgtttaccattgactccttagtgcacagaacaatacttggtatgtcgttcaataaatatttgcttaatgaacaaatgaacgaaactttaaaattccaacataattttcaaacagactccctgaacaattggtttatctcattggtgaaagtgacccttctacacatttaagcatgtgagctgtatattaagcatacatatattttattatggtttaaaatttctttgcatcagatcataccgttaaagtacatattcatggaaataccattatagtcacttaaaatagtctctggtattttctttcacctatgaaaattaaaactaataatttggtccctgaaaatttaatctagaagcatgctagttctcttatctcttcattggtaactgcagataaactgacaagctttaaaataatatggtaagcaaaagataatggaaatgaaatgatcaattataagccaaagaaaatgcaatccaatatgcacagcataaaatatatattgtttaaaatcaagaactggattttataaagtttttaagtgtactaaatgtaattttgattcaacaaagagaagagcataacttatgaagcttaaatgagttataattcttcttattccaaatactttcaaaatataagtattattcgaagaagttctatgtagattaattaaaagcaataaagcagaaaaagaggcatattaacttcatttcacaatggttcatagacttttcaaataaaagagaaaaaatgcttctaatataccttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactgaaatagaataaacaaaaaaaaaatgtgataataatgtgtaaaagcacataagcaaagatgctataaagagacacagactatttcatctagatgcacagcactctttatacaaaagcccaccacagaaattgaaaggcccctaaagttgtaaaacagcccacaccagtttaaacctagaaacaagaaaaatagaaaaaaaaaaatcccttcttaatcaacagctttcctacagcagaaaataaataagaattggtttgggcatatctaaggactttatttaaaataggggtgcaccaacaccattcaaacaaagggttttaaaacaattttttattgtcagtaccccctcttagtttacttttcttcagtttgaatggatattttgtgtgtgtcactggcatggctctctatagcatttcttgtagacaaatacctggctccctacagtttcatgctaagaaattcctctcttctctacactgcaataaatataaatataaaaagttgttttaaaatatgtcttttgcacaaactgtttttcattaaaatatgcattattctcaatgacgttgggtaacttttctatattaagttttgaaaatagtgctgggctgtttagaaattcattaactattaacaaggactagaatctacattaggaaaaaaactgcaaaaataattttttaaaggtataatgttgttctcacattttaactgtaagctcttccatatacagtacttgcattattaagaaaaatataaaataaatgctactgaatgtcataagaattatagtgtgaaaaatatccattcactcaaatggaagagtctgtctttaataaacgtaatttaggcaagttatttgcatgcttcagccaatgcttaaaccccaataagaccttagctatgtactatgatctgaattatgtctccccagattcacatgttgaagccctaatccccagtgtgatggtatttggagatggggcctttgagaggtaattaagtttagatgagttcatgaagttggggccctggtccagtgggattagtgcacttataaaaagagacatcaaagagcctgctcacttgctctttctctgctatatgaggaagcgagaaaatgctctctgtgacccaaggagagagccctcacagacagcaaccattctggcaccttggtctggacttcaagtctccaactatgagaaaataaatttctgttgcttaagccacctaggctttggtattttgttatggcagcctgagctgactaatacactatgaatggtatcaataactcaaagttgatgttaattgtttgaccataagatgctgtaattccctttactacagaaacaatgaaatttaaaatgtcatattttgttacaaggagatcactactgtttataaaggaaaaatgaaaaaacatcaaataatcaaatacaccaagatctatgcagttgtccaacgctaagattacaactaccttacagaaaatgcacatttagatttttttaatgtctaagtatgtacctaaaattgttccttattcaacccactgttttgagtttatgattaatgatagctgcatgccatccatagaagaggatacaccacactcaatgccctgttaacagtcttccctttagctcagaatgatgtataataaactaatggagggagaaaatacctcaagatttaattggggaagggaaagtgtgaacagtttattcatcaccaggaaggcatccagaagcataattgctagattcaaaaagtagacagcccttgtggttcaactggacactgtgtgcttccaggaataaataggtgtgatagcacatgatagcacacacagagagcaccactgtttccctgcaaggaagacttaccctacttggactttaaattcctccaactgtaaaataggaggaaaacgggaagatgcctatagataatctccaaagacttttcagaattagcatgctaaggctccctaatacctgatgactgttaagcagttctttttcagactcaaattgtaacccattcctgaatcaggacgcccacttgctaaggcacagtctgcattttttaatgaagtaaaatacaaaataatagaaactatagaccatatcacacataatagggtaagtgttgcttaaccaaactttagttacacatcatatataacatgaacatgtatactggatcatgatgtaaaatgtatttcttgctgtgaatggcagtcacgagcttgaatgccaccacccttaaggatgtcagaattgccaactgtacatcattaaagacaccctcctacatacaattagaaaaaaagaaacagtgcagtcaaataaatatataattaataccatcagatagcttagctgtgcagcatttgtgttgaaattttagctggacaggtggtcagggatagtcacggtagtcatggagagtggcaactgtccaatcaccacgaagaacacagagatgtagagatgataaaactcaaagctcccctcatgataagagaatgagaacagaatacgaacagtgcagcagaactgaattaatggcaagcctgacttatttaaaatagctatctaccagcaagtggaatgaacacaattttggacagtggcctatttctggcttcaaacaatcttgatatttattatactttgacttaacaaagttgaaccagaaacaaaagaaagcagttgtcttagaaagggtggtgcctcccagagtgggaacaaacaggatgagagtccagcgcctgaagagtgagggcaacaaaaccaaccggttataccatggacaaggaggctcaaacaccctcacaagcacaccctttcacctccaaaacaatgaacaaacaaattacggaaagggtaggatcatcaagtgctactcagaaaactattcaggatgattgtacggaatgctatctgccttaataaaactccatgtgctttcgccagctccttcacatttatgacagctttacttcttttcatgcttgtatctatgacactgctgttctcaagcatgctgccctgatgtttgctgtggccttttaaggtttcagatgtcctcgtgttcagcgcgttgacatttttcataaagactctaagtttgaagttaagctcctattcactggtctcttgccacattagggtgacctcaaatgggccttgtatgtgtgaaacaccaaagtaaggtagcattataggtaggggctaggtatatattacaaaagagaccgcaaagtatgctcaaaaccgtttcagcaaatagttatgtgcattttggcttccgcttctgctcttccttcttcctcaccagtttttatgagtcagaagtttttctgcctctttcctaaacatgtccttatgggaaagtggggggctggttcagagagaggatgaaggaagctcaaggaattagggcaagttccttccttagcattttacacaattgagatctggttataataaatgctgaatctgaaagcttcaatactgacaaagattctctccttgactaaactgcagtcaggctcctctgagcccaggcctcgaccctagcatccatccttacaggacctgcatcacctggtgttagcaagaaaccttctaactcagtttaaagagagttccctcaccctccatgtctgaccaccctggtcctgccttcagcaagaatcctgttaggtctgtttaaccaaaatcccccctacccttaatgtttcctcttagtaattttccattcactgaccccctccccactcctacccctgctcctccttggctgtaaatccctacttgtccatgttgtatttggagttgagccaagttccatactgaggtctcttttccccttgtgatcattaattttgtgtcaatttgactggccactggcttcccaaattaaacattatttctagggcgttaaacattacttctgaggtgtctgcagggtggttccagatgagattagcatttgaatcggtggactccgttaagtagattgccctccccagtgtgagtccaacccattgaaggtctgaacagaacaaaaggcagaggaaggaatttgtcccttttttccttcctcactgcttgaactgggtcatttgatttcagtttcttcaaccctccctctagagtttacaccactggctcctctggttctcgggctttcagacacaggctaaattaaagcattggctttcccaatctgtagcctgcagacagcagatcctgggacttctcagcctccacaatcacatgagccaattcctcataatctctcatatatatatacatatatatatatatatatatatgtatatatatatgtatatatatatgtatatatgtatgagtatatatatatgagaatatatatatgagtatatatatgagaatattatatatgagtatatatatgagaatatatatatgagtatatatatatgagaatgtatatatgagtatatatatatgagaatatatatatgagtatatatatatgagaatatatatatgagtatatatatatgagaatatatatatgagaatatatatatatgagaatatatatatgagagtatatatacatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagaaaaaatatatatatatatatcctgttggttttgtttctctggagaactctaacatacccctattgcaatgtttcctgaatgaaatctgtttttaccacttcgactgctgttaggcactggttttttaacaatatcaagtatagtagccatgtagttatactacagattgcattaactccttcctttattctacaaatatttatcaaaccataaaagtctaggtataatattgatgggagaagtagaaagtggggaaagctggaggatgacaaccaggaaggaaatagtacaaagataaataagtaaaactgccttccatcagcaaacttaaatcactgtggcagaaataaattagatacatgaaggtctataaaaccagagaggaaattataaattcacaaaaaacataataataaagaactatgagagttcacatgagggagaaatgatatgcagaggaaatagtcaaaaacaacattgacgatagaatgctgggagagtagaaagaggatgctgctactgctgttgatagatgcaggaggcagataaaagggagggtcctcggagaatctctacctgcctgagcagtgggagaataggatggagccatgggaatttcccgtgcgtgcaaggggcaggagcctgccctcttcagttcctgtgtttgtgacctggaaccaatctgtgagatgggggcctgttagcaggaactccgctagctttgctgagaggtcgtttttttcttttttccttttcgcccaataaattccattctcctcacccttcaatgtgtctatgtgcctaattttttctggtcgtgtgacaagaacccagtataagctgaactaaggaacaaagttctgcaacactgtgattagggaacctaggaagagaagcccatttggcaggatggtggcaactttggttttagacatttcaagttgcaatgctcctgggaccccaaatgcaaatgattggtgagctttccctgagaaaggtagagaccagagacaaggatgtggcttcttctgcaatgaggtcatagctgagtgggagtagtggagctgatcaggagaatcagcatatagaaagaagaacaaaggcttgagaatgcatacacgatttgtgcaaaagcacgaaaaagagccagtatataagcccgagtgaattaagctcaaaacataagaaacaatccagaccagtcaaatttggtagatgtctgtggtttttgccttcctggaatgatgaaagacatgtaacccttgggtttttgtcccatcatctagtaacagacctccttactgccatgggaactgccttccatgtgattttggtaagcataggagcagtctggatcctataatcacctgtgctactgaaaaactctttctccactagtcctgctgtgagtctggggacatcttaaaccatttctgccgccatgtgaaagaaggctaactaagaagtggagaaagacagattttcaataccatcacaataccctggataagctgtacctaaagctgatgtgcaccctgactcttaagttatgtgggccaatgaattccctttcggcttaagctaattaaagttgattttttttcactcttacaaataaaagagtactgatggatacataaagtaattatttaaaagtcacttttaaaagctagtgaatgaatgctacatcataacctataggaaaacaaaaagataagcctttccactctttaaagcttccacacttcttcctgttctccacacacaggctgttttgtctgcttggttgtcttatcaagtggcacccattaaataatacaatacagtaagaccatctgatcctgtaccattataccaaggccttcacatcacaccagaaatgaaatatcatcccattcaaaagccaccccagaaatggtttcagattttgttttgcaatagattgagattctgtgggaggctgagtagctcacattcccaataaggaaagtgctaggtgtggttgtattctctctgtggaggtaaaggcagggagacacagatttttgtaatgcatttagactcaatgacaatcaactttaaataccattacaaagccccagagggagcaagcagcagaactggggttagaatccaagtctgaaagagctctgtctagcttcttttattttagtcacctctaccctgcgctgccctgccagtgattgctacagctgttgctattcagtaagaactacagctactttctgaaatttgccatgtatgcagctgtgatgaaagccatgaaacccatccttcccccaccccaagtaagtggcgatctcctgttctttaaagagatgcaacaagtaagaggtttaataagaatccacctataatcttcatctgttctgctcttatagaagcccattccacttctccttcattctcattcatttattcattaactgaacaggttgctcacaccttctctgagtcaggtattccagtaggtgttgagaataagacatggttttcatcttcaacaatctcatcattcagcatagaaaggagatacatataaaacagataagcaaataaaaatatgcacaacatatcatgtgattaaaggaatgaggtcagggaaggcttcctagaggaggagatacatgtgctaagtttgttattttgatgcatctgattcttggggaaataagacatgatacacaaaaaaattaatggagagatcagtaacgcaaatgagtatgcaattagttggtgaataaattttataagcaatagttatcataagagttctgggaagcatataaggactacagtaatagcaaaccataatatatgcttaacacgtataacctctttaatcaaccacttaaatagattttaggttaaatttggatgaagaaatcctgtctagaaaggtaaatttctaacggtacaagattaaacaatgtaaaagtgttaaagacagaattcagatatatgtgttctcatgccttttgacttgtaagccagtattctggctgctatgtcttggtccaacactgagaaggattcaatgaaagaatcattgagaccctggcagagaatgcactttgttgcccctaatagtgagttgaaacacacaattaaattaactgttaaaccatatttaggatcccactcagagacagacttcaaaaataaccctacaataagaaattacttaatggacacaatatgtattattcaggtgatggctacactaaaagcccagatttcaccactacccaatatattcatgtaacaaaactgcccttgtacttacatttatacaaataaaaaagtccggccagctgcagtggctcacacctgtaatcccagcactttgggaggccgaggcgggcagatcatgaggtcaagagatcaagaccatcctggccaacatggtgaaaccccgtctatactaaaaatataaaaattacctgagcgtgttggtgcatgcctgtaatcccagctactcggaaggctgaggcaggagaatcgct

SEQ ID NO: 2109 - DNA, 115991 bp, Homo sapiens
agtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccgggtaagccaaactcgggcgagtgggggcccggcaggggacgcgtggcccaagtcctgccgcccagccctccgcaccccctccagccccactcggacttcctcattcctgcgctaaccgctgggctagaccgtgggaggaggttgacagtagctgagaggcacatgggattagcgacagcggggaaagacacatccggacctcgcaggggctagtcggccgaagggccgcggccgcccggcggtcatttctcttcacgtccctccgcggggcgggaacgcgaaccgaaggggaactcttacaaacttttaaaatccccaaccccagccccacctgggggatggtgagaaggttggagtgcgctgcggcgcggaggagagagggaaggtggttggtgcagtgcagaaccagatttcacctaagggcgttccatgaaatgaaagcagaagtgcttgtcagtcctcttggctgggaaagccctccccagctccccagaattgaataggagagtctattcatccctctcctacttctaaaagaaacctggctcgctctctgtctctctctctctcccccctccccccctccgtgcgcgcgcgcgcgcgcacacacacacacacacacacacacacacacacacgatatagtcacctgctataggacttgattctgatcctccggggcctggcatttgagagagaaaataaattacctacctggatacttagagcactttttagacttgattatgtaaaactcttggacagtgccaccatgcattatgcatgaccgctgaaacaaaaataatgtaaaaacaaggcctatcctaaatgcaagtttttctatggtccttaaaaacagacaccagggaatgtttgccctgacttgctggtttatcctgaaactcaaatgggacttaatgatacaggatttaattatcaagattgacatgttcatggactttgttaagtagaggttttcagcattacagtttatgaaataaccatatttaactcaaagatttttttataaagctcataatctgaaaaaatgcttatggtattactaaaacatttaatagctctggcatcaaaatattctacatactggtgatcttttagtaaatagtaaaggttagggtcaagatattcaataatttttttctagcagaatcccacaactgaatattgtcaagcagtttaaactgcattcgtgtttgttaaaactttaaaagggaaacttaaaactaaagtatgttgtttttctgattttaatattgtgctttctagagatgaatccttttactgtttgaggcactataggaattatgtatttaaatgtatgtatttaaatttgaagcaatgtacttttttgagtttataaacttgggaagacaggaaataaaaagatttgtttcctgtagaattttacattcatgatttaattgaattgctaaaatggaaagaacatgtacgattaatggagacttggaatctgagattattcatccatattgatacacctgcaattcctaaatgccctcccctgcttgtttagataaaatgtcttcctgggctgcagcctactggacaaacttgaacacaaaggaacacacgttatatgtacatttaatactggaaccgaaaagctgcttgcagtgaaaagcaaaccacttctaaactctttgagactttttaaagaaggtagtataatccttttaggggttggtggtgatgtgaaaatctattatctttttgctgaaatttcattcttatgttaggcattggcactcacttgtgctgagtaaatgcccgtgtttttcaaacccagatagtaaatactgggggtatacatacaaaaatagtccttcccctttgtaagcattgctttgatctttgcacttcctttttactctacctcttaaacaagatctgtgttgattgagttgattaaagcacaattaatctgaaataggcagaattttagatttagtgattatattccttacatttctgttgttactgttcctggaaacaaattgaagtagtttgagaaactaatatttatgcaggttgttttaactacacttttagacttgcagataattgattaagtaagttactaccttgactttcagggattgctcattgtggtagatacgaggtctagatagggaattggcagctacatgaatgttggactatcattccatcagcaagaccttatttttacctaatttatgagaggtatttctctgttcagaagaggtgaaagttctggcttctggggggaagtggttacttcataaccttcaattggtttgaacttgggagaagtaagaaaagtagtcgatattttcaaacagtaaaataattgtatctgagttgctgtatggatttttgatgaagtactcaaaatgtcatcttttgcatcttcgggtcttagtagatgtgctattctgagtatagaattgactgcagtaggaagtgtatctggaaatgcacagtactgttgtataaccaatagagtaaattctcagattatgctcttctggtccacagattgatcagaaatcacattaacaggaatggatgtctatgcaaaatttctcattaattttcttacttttagtaggaagtttgttttattcggttggtctgttggttttctgtttacaaggtgaattgtctacagtagtgggattgttatattagaagagaaggagaaggaaaaatagaagttagtgctagaggatatgttaagatgttctgctcctacatctacatttgtgtctaatcagcattaattgatgactacgtcttggtaaacagtagaccatactggagcaatttactctgctttttgggaattagttctcatttgcactcttgcacctcccataaatactgaactcacttgtagtgttcttagaggtcagcaataaaccatcaagagcatatgatctctctttgaattttgtcactactttggagacagacagtttggaagaactgaaggtactcagcctcagggagaaaggtttgaacgttttggcatagtcctgcaagtcagtttggctccttgactgtgaatttttttaatcaaaaaagattaatatttgaaaccacataatttggacagttaatagttctggtaacataaccaagccttttatctttgtagtatttcattaattagtatccagtgcctcacttttagaagaaaaaaagagaaaaaagtagtaacattcttttaatgatgatgaaattgcttcatacctttggtctctgctgtattaggggttgttcctgggtgcaaattaatatactgtcttttacatttccggaggttgttgacctggccttgaagatcagccaacagtttagaaaataagttgtgcaaattgcattgctacacctcaaataatttaaagcctgacagttctgtacagaataagagtcacataagatgtgatttgttaaagattatagaaatctcagaagatagattatggatgaaaatatttgtttaatttagagtactaataataaaaatagtgcattttacattttaaaaagaaaacaatttttattgtgtcatattttctgtagtaacaaacagaattaattatcagtaatacaaatttcatctgctttaatttattgcctgtttttgaaattagaataatgatatatttggtttaattatccattacaaattgccttattatttttcattcatctttcaccattaatccagaaaccttaaaatagcttttattttgacccatgccttcagtagatatcaacagacttgagttcatctatggatcctattagtttaaactgtgacaaattttgactgcttaagctttagaaaagaatttattctttaaaatagccaaaattataaaaaatgaaataaagaaaaagctgtttgagagaatcaaatactctagtttaactaaaaataaataatatctaatcaatactgacgaaagaaatatctgatgcttagcattgtacttgttggtacatagtaagcaatcattaactgttaaatgaatgaatgatatgaagttgttgcaaaatttttttttaaatggacagccatcttctataaggaacaaaaattacattattttgctttgccttctggaaagaaaggagcacaaaatagtccttgtgtcttagatattatggaaatcttatctaaagaccacttgaagtttactagaacaaataatttattaaaaagtatctggcgccttccaaaaggggaacatttcattctgaaagaggcatttatgaactagaaaaaaaatgccttttagtttcaaagttttagaggcaccagagcaagattataaagtaattggaatgataaaaggtgcttgtaaaattgaaaaatgtaattttttggtgaagttagaatttctgtacactccattgaaactgtaatatcaaatactaatacctccaaaaaagaaacaatgctacaagcactgcttggtaatctaagaattgttaacacttatctaaattaatcaaccaaaaagttaaaacaaaatatgttattttgttatgttacctctagaattaaacacctatcacccataaatctgtgactgttaaaagttactagatggcaaacctcaggaacaagcaggcagttagcagggtttactgtactttccactttcatactttaatgatttttccaacactatagaagctggggcctcatcctagcacagtttgttcattatttttcagttgtagcattttttaaaagttggccttgaatttctgaattgaaccatttatttttttgtggacacagttttttaaatgaaatataccatttagactagaaaagagcaaaatgccaatactccctgtcctagtgtcattgtgccccctgggaaccctaatgcagtcctgtgggaaaacaaccattttattgagcgctgctcacttcagttcattctgctttgctgccacttagttctggttctgaccctgatctcccctcacatcactcacaacaaacattcaagtttaaaaattaagttaaaagttagttacatatatatgtaactaatgtgtatattaaatatactgatatatattagttacatatacagatatggcaacaacaaaaaaggttatatatatacatatttgtaactaatatgtatattaaatataatgatatatgtataaatacatatttgtaactaatataattatatttaatatatattagttacaaatatgtatatataatattttttgttgttgccagcaaaatgagaaagaaattaaatgttaacatctataacaattgcactgtaaagccgtcattgttgaaaagtactccgaagattaatagcggcagtgtttgttaaaataataaaataatccaggcactctgcctgtgacttccccatgagatggcttccagaaaaagataaatttttgtgtgttcccttacgagttcagtctgcagcttctgggcatgaagagaagcataaacaaaacaaacaaggctctaactttgttataatccttacgctactagtagaaatgtatggacaattcatgcatttcatattggaaaataaagctattagatttttctttgagatgaaccttttttttgtaatttattttttattttttattttttttcagtagagatgggattttgctctgttggccaggctggtctcaaactcctgacctcaagtgatccacccgcctcagcctcccaaagtgccgggattacaggcgtgagccacctagcttggccaaggtgaacctttttgataaatgaggctcactaatatttctaggatttacttttcactaacttgaactaaagaaagtataagacctgcataaagttgagcatacctctataatgtcccattttaaaaagcaatttgtttttaatgacttttatttgttaaaagcagttatttcaaaaaattatttttattatttatcatgtcatttggactgaaaatactataccatatttcagtgttagggcacacctatccctctttatcccagacgtcaattctaccatataacaagtatgtaaaaaagaaaacataaaagtgatgacagactccctaatcaacctatttattggttctaagcccaagcctgcagttcatttaaatagtgaaaatagattacttaattgtcttagaaaatatgtcttccatgacaagaattttaggaatgagaaaataactatttttggatgttttaacacaaattcccaaatcatgttttattgatatttgaagaacctctttgtctaccagttcttaagtataggcttattttgtaaggcttaaacatgtattggtgtttgactgttaagacttgatctataaccttcagtgtctttttcttttaaatggggtatggacttggtaatgaggccagaggagaataccttacaatttatagcatctgcatataatacaagaaccttcatgatttataaaattaaaatgatgatgatgtggaatgatggaagaagcatgtgtgggtggctatttatgtagaggaaattagaagttgaaagcaatgttaagaattaaaattaaattacacttaattttttgctcagttggatagtcaggaaagtacttaaatcagcaattgatttacgtaaaatcaaaactgaaaactgaatatacaatctaggaaataggaaaaaaatttttagtgtgttcatactgctaatttcaaaccaagcaaaaaacctggggaactacttttcagaggagatggcttaaaatgaaccaaaaatatagccatttctctaccctattcatttaatgcattcatttattatactgctaatacatgataaggtgaataggttaagcatcgtttgtatatgtgtatgtgattttaaacctgagtcttttgaaagattggtcaaagcaaaggataatgaaagcataaagatttagggggaagagtcctctataaaactaagacttaaactttgttatcaacttgaatgtgaagatagaataatctagaaagtgaatgagaattataaataaaaggacaaatcatatatctcatggttgagaaatacaatgagataaattgtatatctcatctcatggagggtcataatgaaagaagtaagagagattgcccttggatagaacctttcggcagacatttcataatggattatcatatttttgctaaactggtaagaatggacttttcaccacattatgaaaaaacactttagaagtcagttgcgatcaagcaaatataagtacctgggaaattaaaatcaaaagcacagcagtccaacaatagtcaaatgcatttactcactctcataccatatcatagcgttaatttgagataatgtctttatggtgtctctttatatatttactcgatttcccatttaagacatttaaccaaatttaaaaagcaatccttagaaactttaaaaatatttcctattttaaaccattacataatcatttaccctgcagttacaattctttttttgtgatgggtggggaagtatcccatttctcttagaaagtcttctgtaatagccaaataggagtcaatccaagttgcttagagaggtagttcaatcctgtgttgaaatagatgacttttggagtaattgtgctatatttactgagtatctgttgaactgtaggagtccagtcattcaaggcaagctacagaaatgattttattgctgaggcacttaagtatcttcacatctatatgccaatattaaatttctcatcatccttgatccccacccctttgcacagattggtatccccagcacattagggaatgcggttgttagcctgttagggtccattcagtagatttctcatgccagaaatctagaagcccttcttatacattcagctttcttcttcagtcagtcaccaagttctatcaaggcagcctcctcatctccagaatccatcccttcctcgttgaatttctagattttatttttgcattgtctcctgcttctaacccatcgttcatttcgcataatggtcagctttctaaagtgtaaatcggatcatgtctctgcagtgaatcccagttgtcttcacaagctgattctcgcacacctcacccccttactccctccggtgttccccaaccatcccctaatctcaaatcctccacaccgactttcagtttcctatccacagtttctgactttgaatgcctttgcttatgccctccctgtatgagaagtgccttttctttcctagccatcctgctaacttctaaacccttaggcctggtttgagcatcaccatttctctcacttgcctttctgttttctccctcccctttccataaagagttatgtgcccccattctgtgttctcctgaattcctgtgggtcctagaaaagaaacatcttgagggcaaggagttcatcttatttactttttatttgcacagcacctggtgtgtttgctgaataagtaaataccgaacaagatatcaagagacagtgctgccaattaactgtgtggctctgagcaagttaattaacttctctgagtcttatttttgttctgtaaaaaaaatgaggtttgacaaaatgagcatctctctctaaaattatgtgtttctttgatgtaattgtattaattggaagacttcagattttcttgccatatcaagataggtcaacttaagaaaaatgcatgtgagtaagtaccaagccaattcttgattatcagtatgataatatgaggaactgcccattttgtcgataataagttataatttttggtctcagtgtaggttctttctcaaatccagatgtttctggtgttgcattttttcattattattcagtctctcgcattcatatttctccaaagaaatttatggaaaacttgagacaaaaattgaatgtaaagtttaatatttaaatgctagattgattcaaggtctcactaattataactatatttggagggagaagaaggggaggtggtggtagtatgagctgaatcctcctctgttccttcctagaaggaacacaacgtcctacatcaagaaaaaagacagaagcatatcttggagatatgaaaagaaccaccaggtaaactaaaaagaaaaagagtgttaaaaagtcagcctttaaaaagcaggattggagatgaggaggggtggagtaggggaagcattgcttgtttatagaagctcttccatcttcgtatagtgtgatttttatttttttattattttttccttccttttttttgacctccagctttagtatagtacagttgacagaaattatatatgtttatggtacacaagatgatgttttgatatacatatgcattgtgaaatgattaaatcaagctgattaacataagtagggttttatttctttaacagtgatttatttgaatatatgttgagtcctttctatgtgccagacacagttctaaggacaaggcacacagtgccaaacaagacagaaatccagaaattcatggagcttaaatcatgtagtcttttcagtttttaaaattttcttgctgggcgtagtggctcatatctgtaatcccagtacttcaggaggccgagaagggaggattgcttaaacccaggaatttgagaccagcatggacaaaatagcgagaccccagtctctacaaaaaatttaaaaattagctgggcatggtggcacatgcctgtggtcccagctcttcaggaggccgaggtaggaggttcacttgagcctgggaggttgaggcttcagtgagcagcgattgtgccactgcagtccagtctaggcaacaaagcaagactgtctcaaaaaaggaaaaaaaaaatagaaagagaaactttatttttacattagccttttttaagttgaagaatcccatagctaaaaaagtacacaaatattaatgctgcaactttagtgatttatctcaaggtgaacacgtttaacctagtgggtggtcaagaaatagaacactggcagcactgcaaaagcatcctatctgccctttcttagttaggaccccttccctccactgtcatttaaaagatttcacaaacaacttttggattatatgtatgtcaattctgtgactcatatatatccacatagacaatggagcgttgactgaatgaattcattattccaaggtgctaataatgagcttcacaccagcgggaactctgctgtgtcagttgggctctaagctcagttcatttcagatattcctcactaaacaaaatactgtttttcctcagttgttagtaaaaaatagaaaacagattacattctcatttacttattacttatgaatgtaaaagtaaatattttgcttaataccaagtagccagggtcactgacagagacatgggagaaagaagtattcacatctgatgttatcagacatagaagagagaggtatagttcacctatttctccccactcagtttatacattgacatctgtatgtgtgttgttttgttttgttttgtttgtttgttttgagatgtggtgtcgctctgtcacacaggctggaatgcagtggcgcaatcatggctcactgcagcctcgacttcctggtcccaagctatcctcccacctcagccacccaagtaggtgggactacaggcatgcaccaccacacctggcaaaattttaattttattttactttttaaaatttttgtagagatggggtctccctatgttgccaaggcttgtccccaaatacctggacctcccaaagtgctgggattataggtgtgagccaccacacccagccatgtatatgttaaagcgtttatctgtatgagtggtcagtgtagaaagggcttcatggagcctgattttgatggcttgcaaattattatatttgtgtatgtgtaatcggaaggccttcgccgtgattatttcttcaaaggaaccctttgtccctccagggtgattgtacccatgttcataggaccaaacattgctggttcacataatgactctttttcttttaaaacataaaggacatatttttatggatttttgaggattaatagaataaaaatctaaagtcatattcagattcaagagaactggatcagtttctctgtatttgaacaaaagaatactaatctctaattcataatgcatgaggtctacttcttcctcagtctgaaaatatgaatattccaaaatggtactcaaggcagaggctatatatcaaaattaaaattctgtgatactatgtttttagggaagaagaaaactgtagcattagaaatgtagacgcaaaaggtcagaacaaagtccagtatgtcaagtccctttataatgccatctgaatgaaagacctcacaccatgaacagaggtattgaagcagtttttatgtggaaatggtaggcagcaatatctcaggagtgactttaattataacatttaaggttttatctaacttattataatccttagagaacttctctagctctacaagttattcttggcagaatttgtcctaacatagtattaataaaaataaattttacttgagtatgatataaattactcttaattacaatataattttaaaatgcccaaaacatcttttgatcttatgaatttcagtcagctatgattaagaagacaaccataggcaaaaatttctttcttatggaacacgttggaatgcattctaatcacttctctaagaaaatccctgtcccccatgattatagtgaatatgatacagcaataatttagatgcttctttcaggggggtgaggttatgtattctacagtctattgattctaagaggcacttttttctcccccaatttaacagttttgtttaattatatacatttcaggattttttggggatatttttctatcactggtttctgatttaattccactgtatttagataacatattccgcatgctttcaattctttgaaatttattgagacttactttatggctcgggacgtggtctatcttcgtgaatattccgtgtgtatttaaaaataatgtggactctgggccgggcgcggtggctcacggctgtaatcctagcactttgggagtccgaggcaggcaaatcatgaggtcaggagatcgagaccatcctggctcacacggtgaaaccccatctctactaaaaaaatacaaaaacttagccaggcgttgtggtgggcgcctgtagtcccagctactcaggaggctgaggcaggagaacagcgtgaacccaggaggcagagcttgcagtgagccgagatggcgccactgcactccagcctgggtgacagagcgagactccatctcaaaaaaaaaaagaaaataataataataataatgtggactctaaaatcattcagtggggtgttgtagacacactaggttcttttgattgacagttttgttcctaagccttctatatctttcctaccatggtttgaatgtgtccccaccaaattcaggtgttgaaacaggatgaccaatgtgatggtaggaaaaggtagagcctgtaagaagtgatgggattaggtgcccttttaaaagggcttgctggaggaaatttgtctcctcttgcctttccgccctctgccagttgcggacacagcattcctcccctctagaggatgcatccctcaccagataccaaatgctggtgccttgatcttgggcttcccgttgccagaactgtgagaaataaacctgggctctttataaattacccagtctcagctattctgttatagcagcattgacagactaagacatttcctgacactctgttgatttgctttgatcaattaccgagagaggaatgttaaaaatcttaactgtaattgtggatttgtcattttttccattagttctgccacgtttttgcttcatgtattttgaagctttgttaataggtgcgtacacaataagatcattgtttttctttgatgagttggccctttgattcttatatgcaatgttcctctttgtccctggtaatgtttattctcttgaagtctactttatctgatattttagaatgtagcctgcttttcttatatttagcatttgcatgatataactagcccagtgtaccatcttcatacatttaaactgtgtctttaatattaaagtacaattcttatgaaaagcgtatactttaatcttgttttttaaaaatccagtctgatcatctctgtcttctagatgagttcagtccagttccatgtaatattattattattattatttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccatgtaatattattactggtatgttgggtttaagtctctcatcttggtaattaattatctatttgtgctatctcttctttattcttttttttctcctttcctgccatcctttgaataaatcaagtttagtgttttaaattccattttatctccttcattggttactttctaaagtggttactttaccactttagaaaagtatttgtttattacaatatgcatctttgagtctctaattaatgtgagaacttgacaatgttatacttctgtttgtccttctgtgctgttattgttatacattttacttctttatatgttataaactccaaaatatattgtcttgttttgctgtgaacagtcaatcgtctgtttaggaaattaagaaagaagaaataaaagtcttctgcttactcacatatttatcattattgatgctttttattctttcatacaggtccaagtgtctatcatttcccttcagcatgaagaacttctttttagcatgtcttttagcaggtctgctggtgatgaatactcttagctcttgtttacttgaaaatgtcaatttcacctttatttttaaaagatttatttgctgaatattctggaccaatctttttttttcttttatcactgtaaaggtgcctttacattgccttctagcttgtactgtatctaatgatcatcagaaacatcatgcttatcatgcttatcaattgttcccccatatataatatgtcctttcttgtcctttgctattttgggattttttttttctctagcattagtttttaacagtttggctgtaatatgcctaaccatggttttatttgtctttatccagcagagagatctttgagattcttggatctgtgggttgattttttaaaaatcaaatttataaaaattctcaactgttatttttttgaatattttttctgtcttttttctgtttctgggattctatgttacaaatacgtaagactgcttaatattgtcctgtaggtcactgaagctgtgttcacttctttctacctttttttctctgtaattcagtttgggtagtttttattgacctttcttctagtttattggtactttcttctataatgttaaatatgctaagtccatctagtgaaatttcatttcagttctaaaatttccattcttttttttaaaagaaaggtatgcatttctttgctgatattgcctatctgttctctcattatgttcatcttttcctttacattattgaccatatgctattagctatttttgtcatttgtgtcattttttttctcagtcttattttcctatttctttgcaggcttcattatgttttattgtacattgtggagagtttgggttttttgtcttcctttaaaacgtgttgagctttgttgtaacaggcagtgaatttactggtggatcacctagttttattaagataggtttagagtagcccttattttaggatgtttctaactcccatcgtgtggtctttctgaaatcacaactgaatgctcacaatgttcagtgatgtctttccaccctggattattacaaattcagtgtctctcagcactatatgatgtctggaatttccatttagctcttagatgcccagaaactgttttctattaggttttgcagggtcttgtcctacactatcacagcttggtatttggccagtgaccagagatgacccctatgtagatttctgaggctcttgctttttgtgtaaagcctttctttgtgatattctgcccattggtgttctctctttgggctctccctgtgtcatgatttggaaagtgtcctcagtcaaaaagtgagggcgaatttagaatttacctaaatcaccttataatatatagccctatgaagtccaatgtcttaaattacatctttaggtattttgtatggtttcacagttgagtatagcaaggagggaggttcagataactgttaatctgtgataactaaaaccagaatttgacattctgacaaacttgaaattgcagtgcttcttaaaattaatacagtattacttaaaaaacaaaaacaaaaaaaccagtgttttccaatttgccaatacaaaaaagcaaaactcccatctctactttttaggaacttctatccatttgagaagatgataaatatataggtaaagttagattgcagtaaaactatgctgtctagtgttaaatcaccagtatatataagttttatagatattatgtgactacagagctataggttataggaaaaatataggatttcttggcagaaattggatttaactagagccttgaagagtggatgctattgaggtagaaaagatggcatttcaggatgcagggcatattgtgaacaaatgtacaagatggaaatgagcaagtcattctgaatgattaatctgtctatcatagagggttttgattaggacatagtagtagttgatgcttataatatgatttaatataataatgtaatgtgctgagtggttgaagtctttggactttatcttataagtaatatggcaataatgtgaaagattcttgaagaggaagaaaccctgcagtgagggagaacagtacagagcctattactgtcattcagaggtgaagcaataaaggtctctcctaggatgttggaaagaaggggcagatccaagaaacaacatgaagaaaataatcagcagaaattggttattgactagatatgtgtgaaaatgatatattggcagaaattgcaaagtcaaaaatggggctcattgcagcaggaatgatgaaattgcttttagatagagaggtgaagggatttaaaacattaacttgttttaaaggtatcactgcttaaagctaacagtgatttattaatatttgcactctgaaagttttaacagttttaattttatgtatacaccacagtgttttggctactatacttgcctcttttgttcagttgggaattgagtaaactaatagagtaaaaaaatgagtacaaagtgggctttgactagaactctaacaaagtgtgatcactgaattaccaagataattaacccataccccacatatactccatttcccatgacacatattatattgcattgtttttgcctatttgccttcctacttcctaaactgttgaattagtttgcttttgttgcattaaaaaaaaggagaatcaccacaaagcaaattaaaagatactgattacttcttccaattctgtgggctgcctagttcatctggcctggcctgctttggctaatctctgaggtcttttggctacttgactggtactgtttgtagctactcagctggtgccctactgctgtttgtctgaagttgttttggctactcagctggtgctagggagcctcagctaggactgcctgtctgtgctccacatggtctttgattttccagtggctggtgcaggcttgtttgcatggtaacaatgttccaagaaagcaagaatgatcattgcaaggcctcttataagctgggtttagaacttgtacttctacctcttcctattggtcagagtatgtccgtaggtctgccaagactcaaagcacagagaaatagatgtttcctcttgttgagtggcatataaaaaaaagtgtggccattgatttcaatctgccacaaccgtaagctctgtgagtacaggaactgcatcactcttttgcactttggtgttgttggcatagtaggcataaatatttttaggtgaatgactaaattaatgaaggaaggaaaacattcaggtagtatttcaatatactgtagttttaaattatatatattatatacatttgacatagtttaatatataagtatatacacatatagttttcatatataagtatattatatattatataaaatatttatatgttatatataaagtatatatataaaatatatagttttaatatgtaagtatatgtatataattatatataatattataagtatatatacttttatcataccatcagtgagtatagacatggttcagggagaatctctttattctccttctatcttttgagatagaccaaagaaaatttttttttaaaaaaagaactatcacttgagttaacattgtttggtatttttatcttcataggtgattgccttgtgaataactcattttgtgtattgtcagaatcctattctgcttttcaggctgtgctatgggtagactagctctaaccagaacacttgggagacctgaagcaaagatactatattaaaataagtaatgttatatgccaaagaggaaaaccacttctgcctcctaaacaactgaaagaaccagagactgtggggtcagattagctagcattactatatgaacctgagcaaatgacttactctctttcagcttcagtgtcttatctaggacattggttctcaggattggtgtgagaattaagagaaatatgtgaagttctagctacagttctttacccatgaggtagtcagtaaagtttacttctttctccatgtgaaccaaagcactgtcatgatgtgatgatgttcattagggtttctcatgctcagcgttattgatatttagggttgcataatgctttattgtgaggggccattctgtgcagtataggatgtgtagcagcatctgtagcctctatacactagatgccagtaggaccacctatccagctgtgacaggcaaaaatgtcttcaaacgttgccaaatgacccctgggggcaaaatgcaaacagtttatctagcagtgacacatagccagccaccttagaaagggaattgtcagcgtacccataagtgtagaatgggaaacaaaatacttgagtcttctcagaatgtctaaaccttttgctgtctatattcctctttttataatttaccacaaacatatattgcttattatgccatctaataaaatggctaacatttgctgtgtattatactcggtgttaataagctttgtatgaactcactagctgaatgttgtatatgtatctgccatacctgttggattgacattccactgtaaacaggtaccttatctttaccagctccaagcacaatgtatttggtatatcaggtagctattctacatgttaattgatcacattgcacccaaatgaaacatggatgtggaagtggaaggaggagctttaaaacatggaaaattagtttatacaaatctaaatgttgtagtgcaccaaattgattcctttttaaaaactttcagaaatcagcttttaaaaaaaaaaagtaactaagccatgatcaacttttctttcatcaccactaagccaatatcagaaagttgtcaatcaacagctcttttaaagttgaaatttttctattgtatttcttatgaagatttcagtagtgcttagaagtttttggctcatttatcatgttttattcactgtatgtcattaattgttaaagatgtcagagtcaaaccttaaattcaggagagatttaaatttttcctttttcctatttaaatatatgtttctaattacataattcagttagaaaattacaatatagaaacatataacttagtaaaagtttccagttactgtatacagattatattgtatactgtattatttttaacagttgcatatttaacttataaatgtggataattataattaaacaatctgttatcaaaggacatacagattatttccagttccttgctgcagtgaatatccttgtacttatttttttacacacttgctcagataatttttaagtacaaattcctgaggtagaattgcagaatcaaaagatactctcatttgagtgtttcacattttatgcaaagtattttgtttcctccagaaaattcctctgtggaagaggcttcctcacattctttatcagtttattagccagcagagaaatgatgaaaagccaccccttttcttgtagtttcatcctcattgctatccaagatgaggtattaaaatcacacctaagtggtgtctgttgtggctgaatataatcttgaaagtagagacacttctctctgattcccaactgtactctctggatggcacctaaaattttattttttcaaactgaaaatcattttaatgagttcgaaaaggttttattttttaaaatgaaatcctatagaaagaatacattttcttacagtgggtcatggtcaaaagtgtgaatatctctgatcctagaaagtttccccagttacaaggacaggcgtgcccccaactccatccttaatggctcaattctgtggctttcaagttaatccactcagtcctacagccttcaccaagaagctcatgtgctacactttggtgttagtgggggcattgtcacacaggttcagaaaataacccattaggcattttatagaactcatcacatgttcagaactaagctagttgtaacattatgtttttcatgtgaaaaaacacaagcaattcactggctattttatttgttgctagctagctatactttctatttctttttccatggtgtgaaaatcttcctagaaacctcactactgggaaaagagatgcagagattagtcccatcttctcccctggaaatttactatcgcccttttggcttcaaggtccttcctcaaaagcaaagaattgaacaagggaaagtgaggggaagggctgggggaacagggaggtagaaggggttttccctggtcttttctaatcctttagttccagacgcttagttggtatttcaacattttagaaataaaacctgcttttataattaatgcaaatattacttagtgattcatcctttccaaatgattcttggtttcttttgacatttcatttttaaattgtgaattaacattgacatcaccatagcgttactgttacctcagctctttacagtgaactgtattgcaaaggctataaaagttcaaattttaactatcacccacgtgagccttggactgctgttaggcttttgaaactgtgatcctttggcaagaattggtgtataaatcatggggaggatattgaaggggaagatcatgtttaatttggcagttgggtgcctgcaattgacagattttcattaaggttttagctatagtagtgatcatgcatcagttctaataaagtaggtttcgtttgaattttaaaaattagagtgaggactgctttatgttaactgtttacattcagaagtctggaaaaccatccacaggtttaaatgtatataatcagtataattaacacgtcaacagcctcacctctgtttttgaggaccataggctaatattatttatgaaggttcaggagatcagtctagatcgacagaaagcttaagggcaaagatggttttaatatttttcttggaagtttgagcttctgtggtattctaaggatagggattttgacattgattgttctagctggtattcagtactgtatttaagtgtaatgtttttactagtattcttcttataactgaaaactatgctaatgattctttactatagatatatactcataaatacgtgtaaaaatccaagtttaccaaaaaatattaagacttaggggatatgttctttgaataggcatttatttgctaattaacatattctaatctcaacaaggttatattcttttcaaaaatccattccatcaaaatctgtcatttttacagatgaagaaacaaaggccacagtgagtttagttaatatccaagatcacacagccagcatgatagaactcttaaatttcaagcgacttaccctctttactctatcaggtcaaatttcccttttttaactgcttgtcttaattgagatttgtttaattgtggctgtctgtatatcttcaatcaatactttcttgttttagacaaatgtttccctgcaaatctgcatgaacttcatgttctgaaggactcagagctgccctttcctttttgttaaagttgtacactgctctgcatccccctagaatgctcatcagctttctcactcttcctcactcacacagtgctccagcaggagaggatttctttgaaaatcagattcttttttggagggctttgtgcttattggagtgttatgtgatatattcattacggtgagggctaaactctttgaacaaagagacctgacagtgcatttgggttaaagaacaaagtttatttctttctctcatcaccaccagcatgagcagcctggatggtcagagcagatctgtctcatggcattgttcagggatcctcattccttccctctcatttatctgccatcccctaggctattaatcatcatgtttttggtagaagccaggtcttctccatgtctgagtttttatggaggaagcatgtcaagggccttaagcccagacctggaagtggtatgcaagagttctgacattgcactggtgagcatttggtcagatggccatctctaactccaacgaagtgtagggtatacactaggtaagcagtcacatttccagctacaatactaattctatggaaaaggagacaacatattttgatgggtagctgacattctcatctgcagtcctaagtactcatgactgctagatagactttatgaaaaaaaaaaagaaaaataaccccaggaattaatatttaccctcagccttgtgtttctttaattttctcatttttcatgtcacatatctaaaatttgatctaaataaatttaaataaaattaacctttatttgaataataataaggacatttctcaaggaagtaaatctcaaatgatatgtgattttagatactatctttatctgaccatgtggttccttgcttctatcagggagggcctctgggtaatagaagattgctagggcctgcagtatattaatgtttagctggagttgattaaatctgagacctatagccttgataataaggacttttatttttgtatttttattgcacttttaatattacagagtttctgtaccagcttgacaacagcagaaacatggcttgcttctgtggaacacgctagagcagcagtccccaacctttttggcatcagggaccagtttcgtggaagacagcgtttccacagactgggggctgggggtgattttgtgatgattcaagcacattacatatattgtgcactttatttctattattattaacattgtaatatgtaattaaataattatacaactcaccataatgtagaatcagtaggagacctgagctgcttttcccacaactagacagtcccatctgggagtgacgggagacagtgacccatctggagacagtgacagtgatcatcaggcgttagattctcataaggagcgggcaatctagatcccttgcatgcacagttcacaatagggtttatgctcctatgagaatctaatgccactgctgatctgacaggacacggagctcaggcagtaatgcaagcgatggggagcagctgtatatacagatgaagcttggctggcttgcctactgctcacctctttttgtgctgcgttatccatagcccagggtttggggacgcctgcactagaggacagagcctggtacactatagcagtcctccccttgtgttatgcagagtactgatcagtcccttttgagcttctcaaccttgtataaaactttgagacagttctgggaccatcacaaggtttatgaagggttagaaaacaatacacttaaggaactaagactgtaaatcgttgaagttcagagggcgataaaaagaaatggcttctaagaatcccagtatgtatgattttttatacaaagcataaagatgatttgtaccaaactcaggacactgtggcgagcttaacacgagggtattgaatcatacgtaagtggtaattcctagattatgcaatctccttgctgttagatttagataccaaagaggaactacatcatgtcctcctcctatggtcttcaaaaaaggattatatttggtcttactggtataatacagtttattcctgcatgaattccatggtgatagaatttttaaagttcattctagtgttacagttttgttttgttttgttttaatacacagcttcagaatggcagaagatgatccatatttgggaaggcctgaacaagtaagtgtcataatctcactgataactttatttaaatatattcatatttcaaaaatatgcaaaggcaacattagtaagttagcattaggaaaattctaaaattagtaaatttttttttaatttcagtttctctgtcctttcatgtgaagttggagaggatatgtcatgtgaaatgagtaacttacacccgctttcacacatattgttgcacaaaaattgtatatgctacaggatagctattgtattagctttctagagctaccataacagatcaccacaaacctgatggcttaaaacaacaaaatacattatttcacagttctgggggctagaagtatgaaatcaaggtgttggcagggttggttccttctggaggctctcaggaagaatctgttccatgcctctcccctagcttctggttggttgctgggaatccttggcttgtagctttatcgctccaatctcttcctccattgtcacgtgcgcttcttcccggcgtgtctctactgtgtctctaaacctaaatctcctctttttttcttccaaaggcatcattggatttagggtacacccttatccaatatgacttcatcttaatttgtttatatctgcgaagaccctatttccaaataaagtcacattcacaggtaccggggattaggagttaaaggtgtctttttgggagggaacacagtttaacccactacagccccttgacatatttatttaatgtgtacacatggatgtagagagtggaatgacagaccatggagattcagaaaggtgagggatgggagggcagtgggatgggggtggatgataagaagttacttaatgggtacaatgtatgttatttgagtgttggataccctaaaaaccctgttttgactactatacaatctatgcatgtaacaaaattgcacttgtaccccatcaatttataccaaaaaaaaattttatttaaaactcatctagtaaggagacagattgttgtagtgaaaagatctttgaactcagaatttgaagatctttatataagtactgactactacagatcagctcctcagacttgaagaatcacttagtccccgtaatcctcacttttctcatttgtaaaatagaaatgctagcaccacactaacagggatgagtcaaaaatattcaatgaatgtgctttgtaagcataaaactgttcctatcattatattagtagttatgaaaggatagcagtgtccttttttctttttctcctatattttattttgaaaaatgttggaaaaaataaatagaaatgttggaataatctaacaaatctacattggttcttaaaaccgacattttcgcttttctctttgctctctttttcgtgtgtgtgtgtgtgtgtatatatgtatatatgtatatgtatatacataatcatttggaagcaattttcagactctggagcaattataatggcaatattaaattatttatgtaatgattccaagaagtatttaaaacatggagatttgttcattcatcagctatttattgaggtattactacgtgccagaacattggcttagtggggaaaaaataagtgatatatacactctaatttcaggaacctactattttaataggaagaacagagacattgttttcatatggtgatatatgctgtagtagtagtctgcgcagagcgggatagaaatgttaataagcagcatcactaggtgctaccttggaggaagagcagagttacggaggactttccgaaggaagtcttcgtaagctgtgttttgaaagatgtagtttgctagactagaaaaggtgaaggaacactaggtgccaggatagcctggtcacatttaaattttagtggcaatcatttaaaatagtggatttctgaaattacacgtgcaaagaatcagccagaaaaataaaaacagaagtggaatatgttttaaaggctctggtatcatttctataaataaaatggacatatatagcatttatcacttcgggtgatattctgattgatttagaaagaatgactgcattgcttttcacattaagatgctcctttctaattttatttttaaaatggtgatttaggataaatctaggaacattttcttttattgcagcaaagacatttggctaattgtattatcaaaaccgtttgttttacctttcgcttttaatgtgctttctctaacaattaagggcgaactaaccagcatgaggattgtgtctgcttgattttaaaccatcctttcctgtctgtacacaggaaatcttatcaacaagagatgattctttatgccacagaagagtaaaacctgctgaaaacattcattttgaaagtttttcttatgtgggcatctttgcgatcatcagtaacaggggtggggcatattctgacatttccatttttgaggcaagcggtcttgaagtttttttctttcttggcttgagcttggtggtttatatttcctaaagtttgcatgtcctcagtgttttagtggagtctggaatttgctctccaccctgacctaataaacaatgcaagctgcagcacaacacaacttctctcttagtctgaagtgaagagtatatctctctcctaaggtgagcccttttgcccactcgccagtcatttagccaccacaggaaagagttttcctgctaggttatcacgtttgctctgagactgttaaaatcctgtatgaaatgaggcccatttttgcagaacatggtttttcattcctgtatttccttttcagcaaacaatgaatagcatcagtgagcttttaatcttataagcattgaagtgaagcgcattctttgttcctcagttgaaaatttgcatccctcaaatggatctgaagtactgtttatttaaacgagatttttcttactcttaatttaactaggcatacgaagatcttcagtaccccagaactttcaataatttactactaagggcaggagacaaactgtaatactggctactaaaagaaacgaaaagctagttcagcacacttactagtctctcataaaaagtaaaatatggctggtttccatgctgtccacagacatttcaaacatataacttctttaggctaaaataaatagcaagctcagaaatacagttttaaagtcctaaatgagccagcggttacaatgttttttgataagtaatgaatagtaatttattaagataaaatgtactttcttcaaaatattctgcatgcccactctgttgctgccctaacacattaccacatacttggggcttaaaacaacacaaatttatacttctgagtcaggagctcagaaatctagaatcaaggtgttggcagggctgctttccttcttgcggctctcatctctttgccttttgagcttctagtggctgcctgctttccctgtgcaccctctcatcactccagcctcttgcttccattgtcatacttcctactattcagtgtgatttcctgaacccctctcatcaggcccacctggacaattcaagacactctcttcatcttattatcattaccttaatgacatacgtaaatttccttttgtcatataaggtagcactcacagtttctgaggattaggatgcagacatgtttagggggtcgttattcagcttaacacacccactaaattccaggtattttgtgttatgctaggaaactgaaggtaaaagaaatgagtgagctcagtgcttagttgtctactccttgtactgtcagttatattttcagttattctgtaaatagtcccagaggtgctctctagcattctttcaggccttgacattggatagctagatgaggggtatatttaccaccatagaggaaatactgatttctaggattatattattttgtttatacttctaagagagtacaagcttcaaatcattcattcaacaactatttaagtatctgttctgtgataagcatgtacttggccctgaagatataccagtaagcaagctagaccaggtccctgcctctggggactttatagccaagttatgcttctcaaatccctttgttacgtaaacgttgtccaaccctatgtaaagttttgtacacatgagaactacctaggtctcatgaagatcttttaaaaccctgatttaaaatattttcagatttttgtttttggctttagtttcattcctattattacattttaggtgtcccaacttcaaatttttcatataatataggaaaaataatgattgaaacatttaaatgttcttctttacagatgtttcatttggatccttctttgactcatacaatatttaatccagaagtatttcaaccacagatggcactgccaacaggtaagaaaactcatccctgttaccctgttgttctgctttcagtcttagtaaaatgcaggatttgttaatagtctgtcctagaaactcagttgtgtacctagaaaggaaatggtgatttgttttaaaaaccaatcttttaacatactttcttgaaatatatttgcacaaaaatatttcatctcaattaccccttgtatggtttactgcatttcatatctgctaggactactcagaaggaatttctttagtcaacataaggattttctttattatctctgtattccttttaagtcctttctcccagattcacacgaggcagtctccactcttcatttctgtttcaaacatttaagagggcctgttgtgtactaccagtgtgccagtcactggggaatcaaagtgtacagaaatcataaaaatcatctcattagaaaaatcatctttataaaagcttataactttgcactctgacaagttggataaaactcataatccttccttctaccatgactgtattaattgtgccgattggcaactgtttaatttcgtaagagtaataaaaaaaaaactctctttcttaaaaaaagtgatttatttgtatgtaagcttggtgtgatggctctttttatgttctgtttctctcctcacttcacccgtcaccagtgggacttaacagatgttcaaaagcagtgtgagtgaattatggaagttatgtgtaaaacagagtttggtaatcgctgaaggaggcatcagctcttttatttaccagggacttgcttgtcttcattgggggactttatcccatttgtattattctcatttaaaattatcatggttactacagtacttacttttcttttgttttagatcagaaaactttttctgcatttatatctttagtatttctaggagttcatgggagggaaaaaagtagatctactatactttcaccttcactagtaaaggtgtatttcagaggtttttctgtctttacccctacaaaacattatttttaggctgccatgtctgagatcttgtgaagtgctgtccaatttgagctctaggtcagcttcctgtgaacaagtaaatgtgttggtagtgtgtgtgtttcttgggaactttttaattctggagttcaaagtatttttcttagtattaatgtattactgaaaatataagaacttggttctgtccacaggaaatacacacattttcacttaatgtcttgtgaatacaaaacagtatcctgaggcagacgttttcttaattttattccttcggatttatgggcatgaaaataagattatcaagataaccatctcagtaaatattctgtggtcacagctttatgttgtagaaattattttgccataatattagaaaaactattcaaattacacctaaaaatctaatttgttagttgttgttacaccatcatttttacctgtatgtttttccctcttcattgcagtgtcatagtacaatttttatagtccaagatatataggatgttgtattcaaatttttaaagaggtagagaggttgattatctaaaccaatattaacttgtaactctaaaatggattattttagtcttctagattttttgaaatctaaaacctttagtagatctagtacttgttgaagactatgggatgcgacataactcttaggtctaaagttaaatttctctgcacagtggaatgtccttttcatggcacagaaatgtggccaaaagaatgttggccttaaaacaacaaatacatgcatatcaaatctaattttctagttgatttaactttaatgtgttgcctgaaagaggaaaaatggctctattttacatgaattttcacatatttaaaggaaattaaatcctacaggaaaaataatagcaaatttgcagttgtttttagcagagttaataaaaagtgagagacttgaagtttaatgtaaacatgcttccaactcctctgtatttttcatgacatccaaatattgctctgttagaggactgtcttgatatgttctttcaccattttaacagggaatgtttttataagtgttacattgtcatacaggctgtatcttagtgtgaaaatatttctatttctaatcaattttatttccatatccaaaattaaattctagccatttggtgggggaatttttaaattatgattatgtttctaaaagtaatttaaaatgtccaggggtgaatttcatacagacaaaagatggtaatttaatacattgaccagtgactcccccttttttttcttgtgtatgcttcatttcagatgcattcatttttcaactcgcttccttgtaaatttcttgaataataacaggaagtaattatacccttgttttctccagttctctagccttatcctgatttatcataatattgaaaagataaaaataaattctctggccgggtgaggtggctcacgcctgtaatcccagcactttgggaggccaaggcaggtagatcacgagctcaggagttcaagaccagcctggccaagatggtgaaaccccgtctctactaaaaaaatacaaaaattagctgggcatggtggtaggcgcctgtaattccagctcctctggaggctgaggcagagaattgcttgaacccaggaagcagagattgtggtgagccgagattgtgccatggcactccagcctgggtgacagagtgagactctgtctcaaaaaaaaataaaaaaaattttgagaaaattctcttttgtgttatagtttatttttaatttcaacctgaaggtttatctccttacaaatttatttaaaataagaggtcttgagcttctttctgagagaaaatgaagattaaaatggacatacaagcattctcctaaaatatttttagcaccaaacatcttaatttgcattcaaataaatgagaaccaccatatgcctttatttattgcaaagctatggattattgtactattgacataaaaatcagctgggaagcttaaggactttttcatattgaacagtttgtacttatgttgtcagagattctgattttcctttgaattttcaagtcagataccattagggtatggattaagcctctagttttctttgcgtttttacaataactaatttgcatgtacctatcttcaattaaattattttcagtattttataaaatgcctgagatgttttagaacacagtttatatgatagcacaatattcaaaattgcttataaacatcaaaagttatggattaatatgaaaattttaccatgtctgatagaccagattacattgggagtgtcggggaggaaaggggaaacaaactaaccagttaaggaatgaaggcagtactttcccttcaagtaaagacgggaacagaaaacctagtgtaaggaaaaagagatagcctgagatcattatctgtctatcagacgtatacatacaggttgctagatcagtatcttttaatttcacattaagcacactctctttgaggaaggaaagtcagtgtctaatgatgtgaaggccaaagaaaatgtcatagtgcccagaagtggttgctgcttttaattggtatttgtcattttaaaatgctttgttaggagacaagattatgaaggctgttgacatcaattcttgccggccatatgccttttattgggttaggaaatgtgccatcacctttcaacaaacatttacttattgtggttcgctaaactcgtaaaactattgttaaaataagggttaatttaatatttcagacaaggaagagaaattatatccttgtggaattttaaccaaaaattgatttgaaatttctacataaaaacataatttcagttttttacttgctttacgttttataccaaatttgagaagcctcacagtttcttttggtttctgtttgttgtttttgtttttagcagatggcccataccttcaaatattagagcaacctaaacaggtaagattaaaggggtgggactttaaatgttagattccagtgtctaatattgagatcataagcactgaagaatagtaaatgagttctatgaaggaagtagtttatctgaaagatcaacaacctgacaaattatgtaacagctttattcattcactttacatttctcttactcattgttcacactgtcctgagcctcagtatgtagttctgtaaaactgcagttaattacagtattagaattacagttaattacagtattctgctgtctctaccagcttaacttaccagccactcccaggaaaggcagaggtgatttccattcattttcatttataaggaaatacgtatgcatacagttcacatgcactgagcgatatccatctattatccttgcacatgtagtacctcttagccttcctccttcctttggtagccccagccttttctgtgctgcctttggaacatgtaacctaacatactgaaagtaccagtgggaagtaaaatgttagaatgaactattgaattctcttccctctggtgtcagcctctttggagtcaggagaggaacattttttcaggtgcttccccttaccactagagtctgtagagaatagctcagaactgaaatggcctcctcactgtatccaactctgtggatatttataggaaattggatgggaccaatgctgtgaaagagaaagaaaggcaatctttaatgtctgcctataggaggtttcagttattagggaatggaaataatggtgtagttccccacagaatgaggacagtcagtaaatctttggatggataaactaatcacatttgtgtgtgactgaggatatggatacctgtcctcttgcagctgtattacccaatacattttctaagtattcttttcattagctcaggtgagtgaaacacttttgcattttgtaacatttaacacatgctaactaggtcacaagcttaaataaagcatccactgcgttgtggtttccagaatcgtgacattatatatgtgttatatttggtcagcatttgatataaatgtcttaatgattgctgaacaggctatccttataaggttgaaattagatgaaagtttttgctgtgggggcaagaatgccacatgaaactttggggcatggttctagttcttgcaggtgtcacatcctgactcctcaggttgccagtaacactccattgctctacctccatgttcaactcttttaagcagttatttctcagagaaggtcatcaattcccagtgaaattttatcccttaaagttctgtgggctctggcatcctggaaaatttcccagcttttaagatctaggtagtctatgaaacagaaatcaactgaaatttgtctgcatatgccaaagtattttttccaatatcattttcataagcatagcactacaataagaatttttaaatgtaattccttattatggatccaacagttataaggaaaaattggcatttatgatttacctgaagggttaatgtagttccaaaattcaaaatttaattcatataaaagcttatgtgagtaaaacaatgtgtttaccaaagtgatgctattttgatatctgaattcagtgaaagtaagaaggttgtattcaagtcagactttctgactgaatggatgtagccttgcctttgaggttgatgactcattttaagcaaatggagttactgagatgagtgaatgtggattaaaggcaaaattttgatctcagaaatttagaatcagaaatgcatccagacaatgcatttgacgacatcttcctgaaaacagttgtaaattttcatcctcagattaaaaacttctgaggatttagatactcgtatgtaaccatgaaaaatatctattaagtattgtctatttgacaccactcccaataagatataaacacatacgtgtctatatttttccaactgtcccaaaggaattttgtgattaaagataatgaattgtgtgtgtgtggttttggggttttttttgttttttttttttaagttagaaaaagattcttttttctttgggacctcttagccacagattttccccagctctgacggagatgagtcatagcatagactactaatttttagaacatccagttctgttgcatattaatcagtgttaattaactaatactgttcaaaaactcaagttgtgtttaaattagcagtcaagtaaatctctattcttatggttagctaattctgcaggctattatacatgtgttgtttttttcatggttttagaaatttcatttaattatttaaaaaaccaacagtgtttgcttacaaaaggcatagggctgaaattgtaaattatttttaaatatgaattgtgtgagaaccaaaacaaaggaattacctctgaaacttcatctccaaaggcttcccttgtgtttagatctggaatctcccaaggaattgttttaggtctcactgtgatgagttgatcataaactttagacatttgtgtgcattaaggaaatttcccagaccggggaatttactttatgccttacttatctggtaaatgtgtttgaggactgatctttggaaatcaggaagtttttggataatataggaacagttccagatgcttcccagagatttaaatcagttcaaggcacctggactgctcagagactgcaagaccctacttggcataatgaaatgtagtatagtctaagtagtgcatacgttttacatttgttcatgagctcaaagctgtcaaaatctgcatgtttgctggggttccacaatttaatgagtaagggagtgaacccccaccagcagctagtgggtgtgatgagctgatgggcagatgatctagtgctgtatatgcagagttggtcccacaatagaaacaaaaggtgagaatgttccttaaaaaatcttaacgtattttcttttcaccaaaaagtgaatctgtaaaaagaaaatcatctgcttaagcgactatgtggttataaactactaacactaccacaaattgattgacatcattataaagttgaatcaggaaatacagcgaaacctcccttaatatgatgatgaggtcataattatccttgttttattctttgtatacaaatatgaataagttagctttataaatcataaaaagttagaactggagtagaccttaaagatggtctggtataatcttcccttttgtacaaatgaaaaaatatgacacttcttaggtgtttatcagcccacagtagtttatatagtgaaggcttccagctaacttcattaattaactatatctataaaatttctgggttagatagtatttaagggaactacctagttttggaatcattctggtaggttaatattcaatcttgagcttgaccatattaataatcataaaaacaaaaatcttatcctctgaaatgctgagagaagcttaacagatgcagggtctagcacagggtgtgttctacaacgctgaaacagtatatctaaataaacatgtctgtagtccctgctgaaccagctgtaatcagagtagataaaggaatgtctttaagtaagagtcaaggaagcataacttttattaatatggtacagttcagagcttggcagcagcaatttaagacaaggaagctctgactagaacaagccgtaacatgttaagtctaaagcctaaactcttcagcagattactctccacacatgcatagcatgagaggttccatgggcttaggtacctggctttttagccatatcttagtgtacaaatatcgattaataccatttttcgtagtaagattacgggaaaagtgattcttgtttacagagccctctttcagtttcatgtttttcttctctcatttagtagacataagatttaaaaatttgtatgtacctttgttgccgtaatttttaataagtatttctcaaacttaattggcttaacgttcacctttgcagagaggatttcgtttccgttatgtatgtgaaggcccatcccatggtggactacctggtgcctctagtgaaaagaacaagaagtcttaccctcaggtcaaagtaagtttgtggtagctctccttctatttgaattctggaaattttgatttcctacgatttccaaggaattgctttaaatgagtacgggttgccttcgctcctaagctgaagtgttcacatgattattaaaatttttaaatagaaatttgtctcctagcaatagaagtgacagatactaaaactttgttaacatttcaatttagtagaaatgtcttcagcattagctaacaaacttactatttcttgatcatcttaaatatttttaaaaattggatacttcctgaaactttagtaagtctttgaaagaaatggttgattttgactctttggagatttagtgaaaaaccaaacaagtgactgagtgtatggattatatagtatattatttaagattatgaatttggatccagactttgttattagctgtgtagctttgaataggtttaaccaatacttctaaacttcagtctcttaatgtataaaatacaaaaatattaatagtatatacttcataaggtcctttagagattaaatgagaaaatgtgtacatgttccatagagagcctgaaagtaccctagggccttggcctgagcagatgtgtggccctcttggaatgaactgctacgtgacatgctggtggtgtatttggtcataccttttaccatgttcaggctgtttgtttatttgagaatatttttctttaagttaatatgagacttttaatttcataatatgctatgtttcatagactgactgatgataaacatagactgataatcattttgcagataaacgcagtcaacaattgtaatttagttttttataaaagttattatttagtcagtaattcaaggcttggacaaaatagttctcactatgtgtgtgtgcccctcagggtgtaacatacttttggactcagtctttttattggtttgtttttgtaagtagatgaagctcagtagagcaggccctcagcaaagttgtgatgtaaagaaatctggccgggctcgttgactcatgtctgtaatcccagcactttgggaggccgaggctagcagatcacaaggtcaggagttcgagaccagcctggccaatatggtgaaaccccatctctactaaaaatacaaaaattagctgggtgtggtggtgtacacctgtagtcccagctagtcaggaggctgaggcacaagaatcgcttgaacctgggaagcggaggttgcagtgagccgagactgtgccactggactccatcctggacaacagagcgagactctgtctcaaaaaaaaaaaaaaaaaaaaaagaaagaaatcagtctttggttttgccagccttgcattttgtttcttccttttcctcttatccatcttctaggcccaggcctgttaaatttcttatccttattcccaaacaaaagacaaaatgttgtgacgtcgttctttacctttcaagtgaaactcacccattatttagtatgggtactactagtcatagttgcattttaagtctcttagctccaattgtggaatgaaagatgttttttctattaaaggtaattaggcgggtaaatatgatggcttaagtccacagaagcagaccacggtcttatggcctcacatcctttagaaccttgatgaggaatgaggagcagcaataaagaactaatttgcacttattaaacaccaaagacttgccaagtggtttgtataacattatctcttttaatctcttagaaatctcagtaggtaaaaagtgcaatgcctgtgaacccaaacagactcagagaatggaattataataactggcctttctcacaagactagtggctctatatcctgcagcaggctattgctcaccgaacctctcagatataatgtgtgcatttggggtactgggggcagggagataagggacaaattatgggcagacaatggtgtaaaaaggcatggtgaatgataactcttgaaaacaagggagagagaggctcactggtcaatgggtactcaggtattggggaagccaggcccagcacttacctttttaacacatgtgtctgtgtgtcacatgtataaatattgtgcctttatgtatgtgtatatttgtgagaaggggattgaaagacacatgttatcagcattgacactgactataatgactgaagaattaactttaagcgaaaaactgggagttttttctgactggcttggcacaaaaaatataaattatggtattttgtttacttctattgctctagtattttgtgactaagtaacaattcttgatactaacaaacacatggcattaactttcttataaatttattggctaagaaaaaactttatacatccatttattcccagtcttcatacatctttctcatgtagaggtttcatctactcaaaaacatattgctgcctcagtcacaaaataatttacaaatgaaacaacttagtgggcattagatgttcttgtagaatgaaagtttctatatcaaggagtttagtacttactgggaaatatagatatgtaaacgactaataataaagcaggttcaactacagtcacattatttcaccaaatcatttattttttattcactaattcagtatccatttattaagcatttaatcaacttgtaagaggaggaggaacttagaggttagagaatatgactatacaagctgtcattgttcccttagcttgtcattgttcactgaaaattgaaatggttctgctgttcctaacagttataggaagtaattttatttatccaagaaattcttaattggaaggatgggtaggagagaaagaaagagacaacggccaggtattttttttttccagagctcttctccaaatatcccttttaatagttatttctgctcaggatgacctttaagtttacaaaggaattttaaatccccttttcctctaatgtttaagcagaggaaaaaattgttctccatgcatctttctaatcaggaagacctttaaaattgtgcatgtcttttctgtggtactttactaagcacctgctcggcgagagactgtaagggaaacagtgggatagatacatctaaagtttctcaaacttggcattattgacatttggggcttgaaaattctgtgttgtgggaggctgtctgacacgttataaaatatttagcagcctccctgaccttgactcactagatgctaataggattcctataattgtgacatccaaaaagtctccacattgacaaatgtcccctggggggcaaaatcacccctctttgagaaccactgatgtggatgcaacaaagaatcaaccttaaccttacccatttgcatacttttctactataaagttgtctcgcatagattacgtagaatttccaagtgtattattttataaacgtgcctttcttggttattagtagatatttcttattttcaagatggtgatcatggtgtctgtataatttctgttagaatatcagagttagtgtacctggatactaaggagaaagatagaaaagataaaatatgtatcttcaacattttgtattctgtgatgaccctaaaagctaatgtgggagttctattgactgttataaactattacagaagaaaaagtgaaagtggagagttaggtccactgtgtgtgaacaatgggagggtctatggaatgatgctttcaggtgggcagaggcctcgtggagggtggccccacactcacccccagaatccagaagccattcccacaggaacttcagagggagagcatttacatttacaggaaagaaatgatacttctgagcctacatttgccacatattcattaagtgcatttgttcaggcattacagtaaaatgccatgggctgtgcttttcctcagctacagcctctctccctccaacctcacaccctgtcttcctgtcatgcctttgtgagagcgccaccactctgcggtgcctggagaggaacctggaaacgctgatagttcagtgcatactcggtcatatggagacagcaggaaagagtcaggggccaacttgaaagatttggggcctggctgtggtttgcaggctgtagacaccaaactatactttatagaacatgtgaaaatatagcctgtatgggttactctcttactgattgtctagatttgatgccttacattaaatcattttaaaaccaactctagaagtctactcaaatcctgcattttctagtggaatagtgtcccatgcataaaaccctgtttcgcataggtgtaggctagcttacagaccctcttaccatgttgagattatttctagaactcaggctactgaaccatctggtgctctgcctgtgtctttcacatagctaagaagaaaatttccatttagctttctgatatcttgctgtgcaagtcttcatgctctttttttaaaaaaaattttaattataaattctttcaagcatatagaaagtttaaaaattgacataacagacactatgtactacaacacaaatttaataggtattagcatcttaccttatttgcttttgatagctctctctctctctctctgtcctctctctctctcaaataaaatagttacagctaaaaccccacttatccatcactttgtcctccttccttctcttaggtaagctgctactctgaactttcactccccaagatgtttttatatttttactacataagaatgcatctataaatactggcattttcaagaaagttaatttttactaacttcaacccaaatttgccattgtataggatggctccttttcagggcaaacataggttcaaactggacgccattgaagattaactggtactcactttgatcctattgattcctctttgctgtctagataaaaatgtatttgtcacaatgtagtttgtactaactcttatagcaaaaaataatattcagagaaaaatctaggggaagtaagtatgcagactaactcttatatcttgtcctttcataagaaaaatttcccatcattaaacatttaataatctattatactgcctataaaatttccctttaaagttttttccattctaatttcatcacggagctcctaataggagaggctggcagaaaagcacaggaaccttcctctaggccaagcttgtccctgcctgcttttgactcagcaaggagtgccagggaaggctcacttccctatttttcccgaaagccacgcgtgaagttttaaaaatcaaactgtgttccctttcacagaggtgggtgacaagagaagcagccccatgggacttcagaaactctcaccaatcctcctctagagtgaccagaaagtaccccttcctatcctaactaatgtgacacgtccttctgtgtggtccactctatgcaaaaccagaaattgacaagaatgactttgattgtaaagtacaaatagcttaccagttagtattcttagtttctctttagttataaatatcaaatgcaagggacttgaaacccagctgatagaagtgtaactatttttaatcaaacattttctgaaagctggttctcacatatgttgtctttcctgagtgttttatgttgagtggaagacgtgttgaaatgtttaggtcaacaacagcttttttgttgtccccttccactactgatttaaaaaaaaaaaaaaaaggctccactcttcgtgcctttccttaaaaatcctaaatgttaagtttctgtcgaggtcgaatagagactacccgatctgctgtggcatttgaggatatcacatatccttgcataatctccctttcctttgtatagacttgtctgattcacgtggtttggatctatttggagtactaatttaaaataatttaacctgactcaattacttaaaacaacaggggagaaaatcaccaataatcagctatgtgtgcgtatagaacctagttcatatcatttattaggatttccattgaacccctaagctgttcactgcgcaagtatttaattagggaaaataaccatacccctatgtacattatactgtgtgttttgtaaaccatgagaaaagctgcttattgaacagaagggctttgtaacctggggtctatggatccctgttggtggtttcagacgctttttagattcctaaatttatatgcagacttacacatgtatgtatgtgcattttttcttgggagatgagtataactttttatcatattttcaaagggaaagatttaacatggttaagaatcatgctatagcttgtatcactttagctttttgatagcagctatctttttaaatgatctatgtaatattttttaagattttttctttttttattcttgcatttttaatcaattttaaatgaagtgaaatgctttatgttgctcaacacatagcccagaaagcctcccttcagttttccagtaggtggaaaaaagatgaaactgaattgatggccaaaagagttgaatgggcttcactgctttttctttcttgctcttccatacatttgcagattaagcatgaagctcaccattagtgattgaagccaaaagagagaaggcaattcattgaacaaatattgattgagcactgtgtgtcaggtactgctctagacaagcagacaaaactccctcccatatgtaaccacaattgagacttataggtaatttttgttgcaagtagttcagaagttttgtattttgtcctaaaacaaaatattactttgtaaaatatttttttaaatagccctctaaatccgctgtatatattcaaagtcactattataaagtggagaaagctactcattagagaaaacctatcacacagataatagctgggaagcttaacccttagaaattattaggagagatatacactccttgaatttaagaactgtctgaattttaaattttgttttgtcagttctggcttggtgaccttcctctattggccattcccatttttctgccctccactcttccttgacacatgattatttctgggaccactgttcaatccgaaacaaatctctggtggcttcttttaaacccagtggtctcagtctgaaggtatagtggggcaactctcggcattccattctggagtcttgacctcataaagtcacatattggcaattcgccttgataaggtcaagtgaacacacagaagcactaagatccccacatgtgttccactgcctcctccacagacaagttgtttttcaacccatctgcaggtccagaggtgaagctggaggctaccctgcagtctcagtcttttctccccaccctccagatggattccaaataagaagcctccagactaccttcacctccctggggtctcatggacatgggctggaaagtgcttgcagactttcacagacaatgctttttgcctttaggtccccttctacccaacagaatgattataataatggcttgatgtgcttacttacatcatctcatttaatcatcacagtaatccactgatgcaggttctgtgatccgcattttataaatgaggaaattgaagcctagagaaattaagaagcttaacttgggtctcacaggcttttagagatggagcccaagatttcagttcatgccatatggtttaagggcctgcactcttaaccatcgtggaataccattcattatcataatgttaaggatctgtttctactttgcaggaatcttttaaatctatggttcacaatcatgggtgggcttcagaatcgtccaaaaatgtttcaaccacagagacgcctgggaaccactgcacaattgctaaatcacagtgcatcatctagccaatcttggattctacaataattctatgacagtttctaagaatacatgccattatataatggcaacatattacaacagataattgaatagatattcaatgtataccgtggaatagaatattatgccactgtgttttaaaaagataattaagaggatacggcacaacgtggaaaactgcttataacataatattaaggataaacctcagctgggcatagtggctcacgcctataatcccaacacttttgggaggccaaggcaggaggattgcttgagcccaggattttgaggccagcatgggcaacatagtgagaccctgtctctataaaaaaaattttttaaagaaaaaaaacaggatttcaaattattgctaatatttgtagtgattacaaatattagcttctttttataaagcctgggtggaagcatatagatgtatctttagctttatttattcatccatgacttaaagaagattggttaacacctgactccaccttgagtagcagaacattggactgaaggaaaaaaaaaaatgtgaagctgtcttacttagctacagtttccagcatgttttctcaggagctctatgggagacagtgcagtgtggctctcaaaccttactacccataaaaatctgcttcaaaacctacttaaaatatcgattttattccatttccaaagcctggtagagtaggtaattctcccactacaatacacttagtaacactagaaaaaaaatataacattttctttaatgcatagctgagtttattagaaagtatgaaaactactggggcgccgtaagacaaaagaaaactttgggaaaacacaataggatatgggtggactttggggccacagctgccctggaaatatttgctgacctagataatcaagaagcttggtttttaacagcttcctagagacaaaagataaggccttgggcctttccaatctgaggaattgaaactgcaatcacccacttaattcaggactctctcagggctatagtttctgttgatgggtgatcctcaggcagagaggtgatgaggaagttgcctgtctcagcctagggggaatcagaagataaaatgcctctcttgagaatcaataactacaagcccaattcttacagattcagagttaagtgtatgctccctgaatagagtaggaaaccccaagtctagaaatgaatatgaagttgttccacattggggataccctcagagccttgcagaaaagcataaaaatgtatgtggctcaaagaatcatgagctcctgatcaaaaattagaaaatatgtatgcaaataagccactctgtttaagaactggcagaacaatgaaaagcagaattaaatcctcagaatcttcagataattgaattaccaattgtttgatatataaatacaaaataagtttggaatagaaaacagaccaggcagaatgaaaataaaaccaagtcgaatttttaaaattaaatgtgcgacactgaaaatgattcaacatagttaacatggataatttgaaagaaaggatgagctggcaggtacaaaagaaggagtaagaggtgtctagttgaagtcctagaaagaagtattacaactgcagatttctggctctacatttacagtttctaggtctggggtgaggtttaggtggttgtggaccacacttttaggttttaaagcattggctctgaagtcatttggttcagggctgggcatgatgttggttcctagttttgcgacttgcagtgttacttaacttggctaagcatcagcttccttatctatgaaactgaaaaaataatacctatgtcataggatatatgtgtaaatcaagttattcagtacatgccacacagtaagcacttaaaaatgacagttgcttctatttttatataaccaaatacactactacaaatattgagtggcagctttgctggttcatttatggattcatggagctacacaaaaccttcaccagtctattaatttatttttagtacagtctctctaatcagtattgcttccactgtatattgaccccatatcctttcttctgtctggggttaagataggagactgagatcagctgtgtcaaaagctttcttttagatgtaacacatgatttcttatgaaaatctcataggtaggataccagaaaggaatttattaaattcttgttaggctccttagttgtattagttttgtagggcagtgttttaatttaggatacttatgatagagagcaccccttccataatcaggagaaacacaagatggaaataaagattttattacttagtggtcctggggagcacacagcactccagggaaggccacacaccaagatcagggagcatgtggagaaagagagagaaaggaactcacgggccattgcctttactgggtccaggacattatccaaacaggtttcccacagggagttttaataggtgggtttcaagcaagcaggtatgagttccaggaggtcacagtgtgatgaagaagaagtcactgtggcatatctgcacagtccatgcgaggtgtgagcatcagtgaagaccagtcaggtaggctatatgtagctggcccatggggaggcgatcaccaggtggcaattgtataatgcagatatctagattggccacatagaggaaccgggaggaggtgtagtactggaaactgcgtcgacggtcactgagccctgctttaggtatgagaaagtccagcttatattcagaatggatgcaaaggcagcataaaattaaaagcattcactgccagctgccataacaagttaccacaaactaggtggtttaaagcaaccgaaatttattctttcacagttctggatgctagaagtccaatatcatggtcttcgcagggccgtgccccctttgaaggctctaggcaataatccttccttgcctgtttctagcttcttgtggttgctgacaattcatggcagtttgtgacttgcagctgcatcattccaatttctgtctccatcttcacatgaatactgtcttctctctgtgtccctgtgtccaaatctccctcttctttctcttagagacctgtcattgtgtttacggcatccataaccctatgtgacctcatcttaactaatcataattgcaacgaccccatttccagataatacaatattctgaggctctgggtagatgtgaattctgggggtacaccattcagcccactacaaacatattgtggcattgaggttataagccagtagccctacaagtataggatgatgcccatttcagcctgataatacactccgaaagagatcacatggtaacattgttgcctcagttaatcatagaaatactcaattagtatagaaataacaagaaaaatgctttgttattctcatgtgtcatttatcgagttcttactatgtatctgttattgttatccttatacacttctgcacaaaagatggttttatcccaagttttagcttagaaactgaggcttaatgagtaacttgaccaagaatggcttctctttctccatttccttcctctcatggtgttgttttatatacataaaataatatatattattctattaatatagattaatatatgtatttatatatgtacattttatatatgtataaaacttatgttgtaagttttatatacatataatatatattctgtttatatattgaatttatatatatataaaacttaacactattaagtcttaacactattaagtttcatggtgttgagttatatagttctattaattatatatatatggggggaggggtgtttctccagcctagacttccactttgaaatgtagtctccaggctcagccacttgtttgacattgccacttggatgtctggtagacttaacatattcacaactgaatttcaaatcttccccaccaatctgctctgcctcatagcttcccctttccggaatgtggttgctccatccttccagttgtacaggccccaaatcttggagttttccttgactcctctcttcttctcaaatcccacatgtaatccatcaggtagtcttattggctgtgccttcacacttttttcagaaactaattattcttcagcacctccaatgctgccaccctggtataagctaccatcctcagcatctttcttccagtggattttagcatccatgaatgattatttcctaaatcaattatcaataattgttataaatttgtgatttttctatttctatccttcctgtcacttttcctggtttttttaaaagagctttcttcattcttctttaaaaaaaattaaaattaacatcagtatgaactcgtggattcttttgttattcattgtactataagccattcctgtcattattcattttgattcttaaattgtcctattcttggccagtgggagtctttcatgctagctcctatgtctttttgatatgtccctatcttttttttcctaacactttccttatttctgaaattataagctattctaggttcaccctataccttcactaccccagtccaggcatcgtctgtctctctaagaagtcctagttccttttagcaggagaagtttttctagactctttcattaggcagagctacaaaattgattattttaaaaatctcgagttcatacactaattcataattctaattccaatccaacactgcaggcttcttccctccctcccctcatcccatacttgtatttggatttgagatatgaaatgtgtatctcatatcccatatttcttcagtaactgaaaaccctcatcatcaatgatagcagcatgcttactcattttgctcagtccaataattcacacacatttgtagaaaaatagaatagttttagaatggctataccaatatctgcaagcttactatattcggttcaaaatttctttgtagttcttttgaccaaatgtattcaacagagagcattcagtcagagtaatgtgtacaaaagttacttggattaaattttttccttctgtgtatttatgtttccattgagctatagagttaagctatttttttatttctattccattttaggggttttcccatccctgttgatttagtaattttattttttgaatatcaacatttgtcagtttcacatctttcatttatatgagattaactagaccctttagaaatcattataaagtcaggttgttctattaatttttaaaataggtgtataaaaaccaaagggatcaatcagagccttgatttaaagtacgttctgaattatttcagacacccgaatccatctaaacccagaacatttcatttgtagatttcaaagacttcttggccttcctaccttccttacatttatgtagcatgtgtttatccaaggcacaccacctgccaggcacagtgctgggctctgtgttgacacacatgaatgtgatcatctttctgtagcccccaggttacatggcaccacagccaagatacagacatgtgtgagagagtaatcagggtattactcaggatttgctggaggaatccctcttcaaaggatattctaaattggtgtgtgtgtgtgtgtgtgcgcgcgcgcgcgcgcgcatgtgtgtgtgtgtgtgtgttgaggtggactgggagaaaatataccctccttgagatcacctcctggctagatagtctctcccttctctgtttgtgatagaatgcaagtggaatttgacaggtgtacttctcaaactagaaactagagagctgctatctcagtcaccgtaagaagaacgaatcacaccaaacctacatcattgtcttctatgacaggatttctacaagggtgagatagtgagatgctggagatccctgttttggtagttcagggattcacagcatctcccatgctggtgatgtcaacctgaagagatatttctagtgataggttccagggatctttcaccgaacactttaatatattttatcattgtcctgaatacagccctataaggttcttactaaatttgcaggtgacatgaagtgatagacaacaaacaatttgaattcaaattaattttgaaagctgagacaatggacccaattcttcagcaattatatttaaaagatataaatacatgcagaaaacaaattacaagtacagagtggaagagagatgatttagcagcaacgcatgcaaagagatctaggagttttagttaataacagactcaacatgaaccagcaatgcaatgtgactacgaaacaagtaattcctcattaggctgcattaatggaaacacgatacataagaccaaggaagtggtggtctcatttgcactctgtgatgaaaggccacaccaggaatacagtgtagtactgctgggcaccacatttgtagagaaatagaaaccaacttgagtgtcttcagagcagaatggtgagagaactcaaacttcattcaaatgaggagtagttactgagcctgagaaatttatagcctggaggatttggttgtcttcaaatatatgaatggctgtgatggggaaaaaaggattaaatgtgtcctgttgtcacaagaggatgaaataaggagcggtgaatggaagccccaggcgatagaggtttcagttgctgctgacagtcagggctgtctgaggatggaatgtattgcctcaggacaaagtgagttcattgtcactgaattggttcaaaaatgaccaggaagactacagggcagggaagctaacttgtattacaataagtaatttttttcttttttatttgtatgcccttagaaagatgtttacttaacttgataaatctgtaacaagggataatcaagatttggttataggacaattacaattttctgacagatcccccaaaataatagaaattaatagcttacacactactttatccaagctgtagaatgtataacttacttcatatactttgtgtttagtcagtttatacaggctgaacaacataaagttaagacataaaagggttttttttgcaggtttaaagtactaccatttttccaaattactggctgatcctagaactttgagaaactttggtgtttccccccttcctacttttgtttacatcatagtacgtagatggtacaatattttggttaacctcagtctgacacttagattgtgttctcttttgccctattaatgtctagagtgtaaaaagaccagtaaagtagcaccaagaaatcaaagaaaatttcccagttctactcacttgtaattctcttaatttagtaggggctttccacaggaaatcacaatagaatagttgaaatgctctttatcttatgtactttccttctgaagaaagggacagttaattggctttgttcccaacatggtccaaatttttatacagggcagctgtatttactgtagtacaaaggagattctacaccgaatgatgtctctaagtattttcaataattaagaacctaattgcttctctagccagtgggtttcagtgaaagtgataaaatagattttctaagcaagaaaaatacataatgagggtggttgtatacctttaagaaaaaagaaatcagtgatattcaatcccaagtaaatttggatatcacagagtcagagatattcttaattattttaaattaaatttgagtcaaaaacaatgtgtttaaagactttaaaatcattttaaaagaatgttagaaatttacattaataatttctattttcaatgaataaatgagaaacctagaatttttgttttggacacactttgatcatatctaatgtgttctacttcctctaattatttttatgttattaggatttttaaaaaacctcttagattaaaatttctcagtgtatctttgtttgcgtgtctttttttctctctccacttatgtaattgaagcatttctgacatatcctcagaacacacagattcttatcaggacttaactacccagggcagggccctccttggatttactgaaaataaacactttgggtactcagtctcagttttaatgacaaaagttgaaatctttgcctaacatgaaggtttttctttgtctctaaattttgattttccatgctatcagaggtcccattgcaacaggtaatttgagtgttgattgtatgttttctcagtttgtaattgtggtgaaatgtatttaaaatgttcacaattttaaagttaagtttacctataaggttctttccaactcagaaattctgtgatggtaaactttttttttgtagtttgaaaatgtgatctttggatgttgtcttctgtgtcctatgcatatgactaggaatcatagaattttagagctggaaaatgagtgagacattatctagtgattctgcaaatgaagaattaaaaggcccaaagaggttaggtgactcacgcagtatcatagcagtacctggtgactagaactctggccacctactgcagcactaaaaattaacccaaatgtttttatctgaaaatttgcagacttcaggctaggcctgtaaataaataaataagaagttaaaacatatttgagaaaggtaagcttaatatgccacatttgggaaaagatgtgcctgacacaaatgtatttggtgtaatagagaacattcttccattataccgaaatgaaaattttgaacattctcaaaattcttgaattttgagacatttatgttaagcacagtttattcagactctctataaactgtgctgtcatccctgttgttttctccaagcggaatcatacttaaattacaactttagggagtttaatgtttcctatttttgcactcctgggatatttttcagtgactcagaagcataaactgacactgtgaagttaaggctgtgttccagtgggaatgacagcatgtctctaggacgctgatggagaaagccctcctcatgcagctgtcttgcggagtctccctgctggtggtgaatgtgagatcacacagggccagcagccagggcagtacatctctgagtctcgcttctggttttacctagagccaacccttggtgattgtttgcctccttggccaagcccccacacaataggaaaactgtgtctcaaggtcgaattctattaatacctgagaggtgaatttataaacatttaagatgttttagcatctctgcagccagtgtctctgtaaatgaaaattgcttctcgaagtagaaaagcataagggagtacaagggcttcaaaaaaaaatccttttaggaataagaatattgccagggttaggtgttcctaactggtttcaagcagaggagttagtaaaattccaaaagttaatcagcttcatgtactcaacttttgctaggactttgcagaaactcctcagggatccctcagagttagattagggagatgaaccctgccaaaggacagtaaccattcaacagctggatagcctgttgggccccactgtcctcagcctttcctaatgttgcctgggaacaccacttttctgctccctcctttttcagtgtagcctggagacaattatttatttattcactagctcttttaacaaatattgattaagtaggtactggttctgttctaggggttggaaaaacagagaaaattaaatagtgcctttgtcctcaggaaacaatccatttaatagagagacgaagatatgcccttaaatacctgaatcaccagcataaccagcacctgcggctgccatgtgggaattgttgaacaagataatttttgaatgaaagagtaaatgacctaattgctctaatgtaaagataaatttctaagagtcggctagttgggatgattatagaaggattcaagggagagatgtatgaaagcatagatctaacgagagaaaacagcacagcagaaaaagcagcaaaggctcaaaagtagaaatctctgagatcgaatggagaatagtaaataatttgctggaatgaagagcacgtggaaggcaagggtggtaagaaggctggagatagtagataaggccaaatcatgcaaggatttaaactgtatgtttttagaaaatgggtaagctatagaaattttatataggaatgagaaattatcagcagcattgtgctttaggactacaaatctggtagcaatctgctaactgatattggaagggaaaggcccagagacactagttggaagaattgcagtgattcttcatgagctaaactaagagttcaagctaagatagataaactaaggaatgagaatggaagaaagggacaaactgagatttttggggtggtactcagctgaagtttggcaactggttaaacataaaagacaagagacagagaggaatccaagatgaaaagacgattttgctgcacttttttagaaggcagcatttgtatttccatttccaggaggtggagtagctttgagaagaaaggtgattagttcagttttgggcacattgagctgtaacggtattatggacaggaagataccctacaaacagctggaaattttgcacatgcttaaaaagaagatgagaacatgagatttcaatttagccatcatctgcatggagtagacaattcaatccaggagacttgataagaatgtcaagggagtgatcacgataaaggtgagaaatggactgagcatcgatctctgctgaaacatctctttgagcaggaagaagagtgccttagcaaaagcagccagtgaaatggggagttgggggagactttcaaggagggaatggtaacatatcccattcccaaagaggtcaagtagggttgaggaataataaatggctagtgggtttggaaacatggaatctgtcatgacctttacacactttttcatttgatggatcgggggattacttacatttgcaaagggcctcagattaagtggtaatggttcagcattagtaattagagattttcttatgtactttgtagggagaaatagaatggcattcaaacaggtttaagttcctcttaagaacctttctcattggattgtagagaagagcaaatgaaagaatcgttcagtatttcttggtatcatgcccagcccataggtttcaattaatgttaacctttacagttgtcatcatcattatccagaaggggcttttttttagaataaggaagaaaagcagtgctcatctgtagacaagggaaaaaatcctttggaagagagaaagagaagggtaattcaagaagatcaggaataaacattaagggtaaaaacagaatggttagccctggaaaagggaacaaacatgtttctctgaattaggagaggatatgtgaagtaacagggatgttttgagcctcagtaacagtaaggagaagagagagtgaaggaacttgcacgcagtgacttctaccttctcattaaagtcaagagagaatctcaactgcagatatctgcttaaggtaggaagagagaaataagaattgctgtcatttattttgtggttttgatatagcaaaaactgtactagacactttacctcctttaatcctcagaaaacttagagattatatatttgtattcacattctacaaatgagaaagcaagtaaaaaagttaagtaactctcccagagtcccccagatggtcatgggagcccagattcagagccagctatgtcttactccaaagcctgtgctctttattgaaacatactccactagtttgagatcttggaggtgtacccctgcactactatcaggactacccctgataaagtcctgtggggtagttgttcctatccatcaccacagtgaatatcaaagaagggccctctcatttgaggaataacagacagtgaaattgagatggaccagaaatgcaaatcctggatccctgagggaaacaacaaaatgaagcatagaggaaatatctgagtctggtgccaagactcatcagtacaagagagaatgcctaatgggcaatagcagttagggtgggaaaagagaagtacaagggggtgtcttggaatttgagggaagaactgctgccttagttttcgaaggatgattattcgagagttgccctcccttcactttctcacagctggcagaattcctacctcttagtggttagattcctttttaccagatactgtagggccagtgcagcaaccagagcccccagccagaaaccctgcctccaatttagaccagtgttctgctctggtgtgtaataatcatattctaatttaaatagcctattgagatgctacattgatatctagccttttttttttttttttttacttttaagttttatgtgcaggatgtgcaggtttgttacataggtagacgtgtcatgggggtttgttgtactgattatttcatcactcaggtattaagcctaatatctgttagttctttttcctggtcctgtctgtcctcccaccctccaccctttgataggccccagtgtgtgttgtttccctctatgtggcaatgtgttctcatcatttagctcccacttataagtgagaatatgcagtatctgtaataatgggttttctgttctcgtgttagtttgctaaggataatgacctccagctccatccatgtccctgcaaaggacatgatcttgttctttttcatttctgcatagtattcaattggccattttttaaaagacaaaataacaaaaaaaagagtacagttatctccactcctcacccactacctgccacctaacccaaccctttatattttagtaattgccttccataaataacattttatcctgtcttaattatgcattcattagtgtattaattattgaatgcccacaatatgacaagcattatttcaagcactgaggatacagcagagaataaatcaatatcctcactgtttttattccatttttttaagagacagggtctcaccctgttgcccaggctggagtgcagtggtgcgatcatagcccaatgccaccttgaacttctgggctcaaaggacactcctacctcagtctcccaagtagccggaactacaggtgcacactaccacacccagcttccccactctgagcctccatcctaatggagaagagaggcagtaatcaaaatacatgaaatgtgtagttattagatggttattaatgtatagagaaaaattaagcagagaaaggagcaagggattagggggtcaaagttttggtaggggtagagtggtcagtgaaggccaccttgagagatggcaattatgtaaagcctgaaagcaggtaagaaatatacaggtatacagatgtccctggaaagagtgttctaggcagaagaaatagaaagtgcaaaagctaagattgctcacctggcaagttcaagaacagtgagaaactgatgtggctgcataggagtaagaagaaaaaggacggagaggacatgagatggtcagatagcctagggccttgtaagccattataacgattttgtcttttaatatagagaaatattaaaggtttttgttttaactttttaacatagaaaaatgtaatcgtatacaaacacagaatagtataatgagcccccttgcactaatcactcagctttaacagctttcactttgggaggattttgagtgaaggagtgataagacatggcatggcatgacatggcttgaacaggatcactcaggaaaataagccatggggagacaggacaagcagaggaaacacaggagcaaaagcttaggagacagatgatggtggctggaaaccaagggagtagcagtgaaggtggtgagaagtgatcagatagaggatatttttttgaagatttgaattaatattatatatattatactttaaagaagaatttgaaaatgcatgtagtgtagtaaagatggtaagaaatacagaaaagaggccaggcacagtggctcatgccagtaatcctagcactttaggaggcttaggtgggaagctcccttgaggccatgagttcaaggccagcccgggcaacatagtgagactctgtctatatggaaaaaaaaattaaccaggtgtggtggcatgcacctgtagtcctagctacctaggaggctgaggcaggaagattgcctgagccaggaggttgagtcttcagtgagccatgatcataccactgtactccagcctgaatggcagagcaagaccctgtccctttaaaaaaaaaaaaaaagaaagaaagaaaaagaaatataagaaatggcactagaatatcagtattatatacattattttctgtttaaaaatccacacaactggcaaaaaaaagtgacatacatgaacatttataagacagtgcatttataaattacaaactctctgctcctcccatattattttgcagtgatgaatgattaggccatccaaacgtaaagatttatttgtaatttgctaatgatggaatgacaccttttgaggtacaagttcccagcaattcttggaattagcaatagtgtgttacttctttctcgaaagaagcatgatttgtaagcagctatatctgatgtagtaaaactgaaagttaaaataaaaaaggaaaccgtgggtcaaagtatgagggaaaagataaaactttcagagcaaagttatacatagagattttattcatcgtctctgtgtaactcacgagaacttcttagcttatttattatgtcaaatggcagtttgctcttctaatcccagcctgatatcatgagccatatatgctgttggtcattcaaaaagggcactaaacaaggtgaaagaatgtcagtgaatcaatgcaactccatgagtactaccaggaaaagaaaaacaaaaaaacatgccattaatagtgggtcaaagaggatttttttcatgccatcccctaccttactgagaataccacatttatattcagaagactcataatgaattccagagtcctctgtgtcttggctgtatgactttgggttatgtcactttgttaatctgtttgaacttctgttttcttatctacaaaataggggtaatagagtcaactctgcctccctcacagggactttcggaggcccaagggtctttacaaataatagagaaggaaagaaactggcactttaatagtacctaccatgtaccagggactgcgtagtccccacggcagccctctgaagtcatgtgattggcccattgtgtagatgtagagcttaagactcagagaggttatttaatctgtgtaaggccacagagctaggagggggaaaagctgggattggatcactgactagatcaacttgaaatctcctgcctgacagagaaagaagagactaactttactaagcatctttttatgccagaaactgtgttggacataattctgtactatcttatttggtaaaggtcattctgtccttcctggttgccctggttgctcaacaagtaataaacaataaagcctgactgtttttcatccctgagagaagaaatattattaaaatagcgttattctctttctttctttccttttttttttttttgtgtgtgtgtgtgtgtgcgcctgataatctgacttgcaacctcacagaaaagaatgaatgcatggtttcatgtctgtggcatgactctgtgaaggagccttgcaaggggacagatacacctctaccacttcttatagccattcctgagacctctcttctcacaacacataccagcaaagccaaacaaacaaggtgtttaggaataactgtcatctatcaacactctctaggcaaagtagaactatgaaacactgaggagactgcacacacacagaagaaaaaatgatcatgtcacatggtagcacagagcaatgggaaatgtgaatagtttgttgaggtggacagacccaagctcaaggattgcctgatcgctccatttataggaaccatggcaacctaccttatcttactgagcctcagttcctccagctgtgaaatggggtacaacctctgaccccacagggctgttgtggggattatctgagttagcatgttccataaaacacagtaagttagaaagtatagctgtataggctctgggagtttaacaagcaagagaaatttgacagtaatcatttagttactgaaccctgtcttcatattgcgctaggttgcatatggttttcctgcctgtcccttccaatcacatttcagaaaaaggaggcagtagtggagccttgtgggctaaagtggtgaggagggtgtcatggaagattcaggttcaggtcttcctcttgaagaatgggtgcttctcaatagggaagtggaggaacaacctgggagttgtcagcttgaagaaaatcctgagacgtgataatgggtaggtccaaggaggtcctgagtaggactctgagcacagagcctttctttgcatgtgctgtttttcctgccagcaagaccctctaaaccctttggcctcacccacccccttgcctggttatactcctagccttctttcagatctccaccctcagtactccctcaggaagctttccctgacctcctgacccagtcaagtgcttcttatatatctcctttgtaagctcttctcagttacacttttacatttatttgtgagattatttgattagtgtcagtcccactctttaattctccacaagaacagagattgtgtctgttctgcattcaccatgcatcgcttcatcccctagtttactgcagtgtgtggaacataggacgggctttaaatactcgctgaataaatagagaaatgttggttattagtgaggtattacctaggtgggagagaggatttatatttgggattgctaatcccattaagtgccaagcactgcattaactcatttaatcctaaaaaaaagtcctatgaaatcaagtgtattattccttttaactttaaagacagagaaactgaaatccagagatgttaaccatctttccccgttgacacagctaagtggtaacagtcggtcttgagccgggcagcctggcttcagacttcctagactttaccacattgttctgctgcttagtgcagtagaggacaaagtgaggtgcacacgtgaagtcaggacagatttccgtttgaaaattgtgtattttcccctcctcttcttcattaccattgtcatcatcatcatcatcaatcacttcacaagcaaagctaagcagaaaagaactacttcatgtatcacctcttacattcatgttaactctacattctgccaaagtgatttggctgaatttacccaaagagcaaagtggacatttcaaatcctgattcctagaaaattatagactacatcctgtaaccacctttgaagaaccagcatgtactttaccccaacgtgacaaaattgttttaaataaaaagaggtaatttgactaagattggtatgatctgagacccatggtttctacatcttattcaaaaagcagatccagcatgtggtcatcagtaggtattgagtcataaagctcctggaagaaaatcttaagtttcatcaagaatgccaagaagtcctgggtgtctccaagaatgatagctgttactataataacataattactactggaaaattagcaaagcccaataaaatatggcatgcaaaaaaatatttaccctggaaatagaagtgacctaaatcagtcgtttattccagccacctgcttttagatagtacttaaaaaaaaaactctcaggatggtcatattgtttaaagttctctaggtggaagagtactttacagtaataaattaataaataagacaagttaatgcttttaaactactattatttgttgagcattgttgtaaaggctttacatgcattaatgtatttagtcctcacaacaaccctttgagatactattatcatcatctcccttttacagatggggaaactgagcagtgcccaaagtcacacaaccaggaaatggggaactatcttcaagcccagctggtttgcgcctaaagtccatgctcttacagtgtccctgggtagctgagtactcagttttgtcacctttgtctccttgactttaactgaaagcttaactctttttttttttttttttttttaaacggagtcttgctctgtcacccaggctggaggggcagtgtcttgatcttggctcactgcaacctccacctcctgggttcaagtgattctcctgccgcctgccgaatagctgggattacaggtgcacaccaccatgcccggctaatattttgtatttttagtaaagacagggcttcaccatgttggccaggctggtctcaaactcctgacctcaggtgatctacccgtctcggcctcccaaagtgctgggattacaggcatgagccaccacgcccggcccgaaagcttaactcttaataagagcctgcaatgttcagacgctttgaaaaaaacctaacagacacagttgctctctataaacttaattttcaaaggaaccactattcaaagaagtaaaagggagactgaataaaaagaactaagttctccgtagagcaaatgaatttctgaatcgattgcaaacagttctccgtcatcatgacatcctatgaagtatggtctcccccatgttagagtgccagtgtcttcatgtaccatataacttgcaaatagtatcactgtcttctcacacttcagctttcttctttcatcagtattttggaaagtccacaaaacccagggggctccctgtctgttgccctgtggtctctgtgaaaaccagatgatgcgatgctgacttggactctttcaaatggatccaacagcacatgagtcactggcagcatgttcagctcctttacctcaggaattacccagttcctcattcttgccacccttcagccgtgaagtagtaatatgaaaaatacatgagtactttttgaggatacctcggacctctttccttcagtaccagagactaattgcctcataatggtaacattgaagagcccagttatctgacgtgattgggctttaattatggattccttctggtgtcctattaaattggaaagcctagctgatttcacccaaatgaagcattacctcatgccttgctctcttgcattcctgtgctggtgtcacttaaaagtgtaattacatggtttatttcgtgttctttcactcttgatttattgctgaagaagcccctgtgggatatatcatcataacaaagactgatttcagatgtcaacaccaagaaacacaactggcatcagcaatctatagagagtatctagggacagcagtcagctttggagaaaacccagaacttctcattccccatcccacatttaagggcaaagactttctccttgttaaagggaaagcactgagttcataattagctttatacccagagttttttttttttaaatgttatacctgtttaagaaattttttgtgctttgaggtggtcaagatcaaatttaattagcaaccctcttcgtgattggcttgctctggggaccctgctctttgagaaggaggttagaaggtttagaagcaaacctttgcagcagttctagccaagtgcatgcatacaggccttgaggtggagctgcacagttgactgtaggggagtctgtcctttgttgacgagtgaaacttctctccctgcaaaccctctggggaataatgccaactctgatcagcttttcgactcttggatgaaatattgggttgggaaaaagtccctactaagaaaattgtaccaaaaccctgcttcaataaaatatgaatccatttaatgaagtttatagtagaagtaggctagtcgaaaaggattctgtctctttccaagtattattggcaggtttagggtcttcctcaagtttatatcattaggacttccatcaaagagttatctttaggtgtgattcccatcctccctccctctctccctccctccctccgtcccatcgttccttcctccctttcctccttccttttctacctttctttttctctctgtctctctttctttcaagctgtgggctgcttgtacagatttatgcattttgaattactgcatagttgagagatttggggcttaggttattcagttcttcaaaaagtacagtatgagctaaggagatagggtgaccaactaatctaggttttggctccaaaaaccctgtgtcccagaaaacccctcagtcctaggcaaaccaggatagtagttcatcttgtgaggagattatagtgcatttccaagtatttagctgaatttatcacagggctctgacttgataggatttaagagggttaaaataaggtcttttctgttatgttagtgtgactttagtcttggcactttctcaaggaaggaatccagtctactacaggggctaggtgactaaggagaagaaagaggatatctaagtgttttttgctaaaaatgtcattatctccatgctatttcctttttattgctattgtcatcattttaaagacataccaataagaaataaattactttaaatagaaaactctaattttatcaagcaacagcaaacaggggtgaaatctaaggatttgtacttaaggagtacacttttttgaattgaagaaacttactatgacctgagcatatgtaactcaattatcagaagtcagagagggctactgaaggctcaggttttctaagagatgactggaggccaagtcctcaggcttgagtgtttatagccaaacttcagaaccaggtccctggcaagattctcctgtctaatcacatggcacagagttaggatggactgtttctgcttacctgccttcttcctttgatttccatcaaccaccagtttctttctcatcaatcatttacccagcttttgtgaccaagaattttgatgaggatgcagaggaaggcatgttcttggttaataggaaaggaggcttcatgacaacacagcatcctctaagatgtgttgctccaactttcacaatacatattgtgttttaagtggcctgcttcttggagtgtatcttcccactacacaaaacaaccaccattaacattttcatttacttccaccctgtcatttgttcatcacatacttttaaaaacagggctgtaatcatgtatatacatatatgaataactttatattgtactttttatacttactggcttatcataaacatgtttccatgttgctggagagtcagatatgctaacttttggaatgtgcttcttatatagatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcgggtaagtaggggtatatgatgctgtggaaggtaggaacagatagaatatgggatgcaggaacttagaatgaacaggcccctttcattagggacctttctgagaccctcagatgacctcaaaaaactgtgtaaacttgtgctttcatttggactccaggaagtaaggtgaccacatgtctggatttgcttgagacagcccagtttgcccctgacctaattgtttatagcaccctcttctactcttaaaggtggcccaatttggatgatcacttatatgtggtcacttgacctacaaggtatttgtgccactattaattttttttctcctagaaataaaaataaggacaaatttaaagaaacataactatagcagaaatcatcactttatgtatatttttacattcttgatgatttcttcagtggatttatggtgtgaatatgtagggctttaagtgaatgcataaatatcatttcagctctctgctgcttagaaagtaatgcacagataagaagccaaggaatgcaaatttattttggcattcattaggcttgaaatgtaaataaaaaatgacgtattcatttaagggttgatcaaataaaacaagcaatttttaatgaatgaagttttatagaagtaatttcaatccaaaagaattaagcttttaaataagacatatttattgtgctaaaaaacatgtattttcatcttcctaatacactaaaatggcacacagaataatagtgtagcacacaatacaaactgatatgtgcaatcaataattctaaaaattgttgttttaagtctttctttggaagtccttaaatgcaaaagaagaaatttttaattttgtttaatttttaaaaacatttttcagggttttctaatcctggtttaaatagtttatgctgaaatcccagttaatctggcttattcactcaaaagaaaggaattgtttaaatcaactataattaagctgatggttgcatttcaggctttgaattccgatcaagtttcaaattggttattattttggaggttgtgctttcatgttcctaggtatttctttgtttgactgtgaaaatatttaagtgtgaaaaacctagagagagagctttcttttaagtcactaaaatcggattcttttgatgttagaaaaaaaaaagactctagattgaaggaagaagcttaaattgatttgaaaaattaaagtgtgctttatatgaacttgtttcaacatcctcttgaaagactggcgtgtctcctgttgtatgtcacagtttgttcatcatgtgttgtggaatacccttccagttcctgattgacctaggagagctttgaaatgcaggctaattatcacagttttagactgattgatcacttagtgtttctgcagatttattccagtagggttctgtcagtttgaagtgtttattttctttggtcttgtttaatccctattataatcatatcctttagaggaaattttagatgaagttttctactagtatttattattataaaacctccagtatggtgtctataatttggtgtttctgtggtttgctttagtaatctttcaggattttagaaagaactaatggttatttaaatttgagaccttaaagcgggaatagaagtaaattgtttctaaggaaagtgagggattctttcactcttgtagtgcagtggggtgtgggctcagtagttgggagaactcatcagtcattcactcattcaacaaacattttgagcatctcagctcctgaatttgatcattatgatgtctggttgtagagcagtgagattttctaaccctatataatttcagtgagaaatttaatcaagatgccacttgagagttacaatagactcagtagtcttaacgtttttagtgtttcctatgaaaagtcagtactcactttctaatttgatttttagctgagaaatttttgcttacaatgtttcccaaaatacactatttctttcataattcatttgtttctatctctctctatatatacatttttaagattttcaatgtcaaaacttattgcatttatgtagaaagaacatcgtgctagcattctggaaaccagtattttattcccagtactgttgctctcaacagaggactgggggcaagttacatgacttcttggggaccttaatgtcttccctcataaaatgagagagtttcactacagaatcttatcttcaggctgtttacatctccagaattctggactgaactaacattacgtaatattatgaaataacatgagcaaacttgccacacacatatttatggtatgacattgattattagtatttagttctgacttgtagataagagtatcacatagagaaacttaggaagatagccaaaattatgtcttagacttgtcaatactagaaatgaagctaagataacttgttttcaataatacagattaggcaaagagtatagattcacaagcaagacactaatccaacataccaaaaaagatatccaaaaaatggcaatgagaagacaaataacttttaaattgtcaaaaccaaaagaattactttctttggagtgtttatcttcatctttccctcagtatgaattcttaataaacttagtttctactttcaaaaggattttatctatgttataaatattcatgttttaaatagccaagtcttgattctggtttgattgctgtaatgtaggggatttgtcattttaatattttttaagttagctttaattttgtcttttttaaaattcatttatataattagcctttactgcctttcttggtaaaaaataataataataatcttagtttggtgttttattttaaaccctgaatatcaacaatttgtttcaacatattttagttcgttgacatttttattccatggaaaatatctgtgttccttgactttgctttaggccagttcacttaccagtaatcaccacactctctctgctttctggcagtttagagacatggaatttttttccaattaatacatatagcatataccaactggtaagcactaggagtagatatataaatatcaaaatacagaggagaaacaaggccttcttcagtgtctgttgttcccctttttgtccatgagttctcatcatttagctcccacttacaagtgagaacatgcagtatttgtttttctgttcctgcattagtttgctaaggacagtggcctctagctccatccatgttcctgcaaaacatatgatcttattcttttttatggctgcatagtattccatggtatatatgtaccacattttctttatttatttatgttattgatagggaatttaggttgattccatgtctttgctattgtggatactgccgcagtgaacattaacatgcatgtgtctttatggtagaatgatttatattcctttggttgtgtacccaacagtgggattgctgggtcaaatggtagttctatttttagctctttgaaaaatcaccacactgctacaaaatcaatgtgcaaaaatcacaagcattcctatacaccaataacagacaaacagagagccaaatcatgagtgaactcccattcacaattgcttcaaagagaataaaatacctaggaatccaacttacaggggatgtgaaggacctcttcaaggagaactacaaacccctgcttaatgaaataaaagaggacacaaactaatggaagaacattccatgctcatggataggaagaatcaatatcgtgaaaatggccatactgcccaaggtaatttatagattcaatgccatccccatcaagctaccaatgactttcttcacagaattggaaaaaactactttcaagttcatatggaaccaaaaaagagcctgcattgccaagacaatcctaagccaaaagaacaaagctggaggcgtcacactacctgacttcaaactatactacaaggctacagtaaccaaaacagcatggtactggtaccaaaacagagatatagaccaatggaacagaacagagccctcagaaataataccgtacatctacaactatctgatctttgacaaacctgacaaaaacaagagatggggaaaggattcctatttaataaatggtgctgggaaaactggctagccatatgtagaaagctgaaactggatcccttccttacaccttatacaaaaattaattcaagatggattaaagacttaaatgttatatctaaaaccataaaaaccctagaagaagacctaggcaataccattcagcacatgggcatgggcaaagacttcatgactaaaacaccaaaagcaatggcaaccaaagccaaaattgacaaatgggatctaattaaactaaagagcttctccacagcaaaagaaactaccatcagagtgaacaggcaacctacagaatgggagaaaatttttacaatgtatccatctgacaaagggctaatatccagaatctataaagaacttaaataaatttacaagaaaaaatcaaacaaccccatcaaaaagtgggcaaaggatatgaacagacacttctcaaaagaagacatttatgcagccaaaagacacatgaaaaaatgctctcattatcactggccatcagagaaatgccaatcaaaaccacaatgagataccatctcacaccagttagaatggcaatcattaaaaagtcgaaacaacaggtgctggagaggttgtggagaaataggaacacttttacactgttggtgggactgtaaactagttcagccattgtggaagacagtgtggcgattcctcaaggatctagaactagaaatgccatttgacccagccatcccattactgggtatatacccaaaggtttataaatcatgctgctataaagacacatgcacacttatgtttattgcagcattattcacaatagcaaagacttggaaccaacccaaatgtccatcagtgataaactggattaagaaaatgtggcatatatacatcatggaatactatgcagccataagaaaggatgagctcatgtcctttgtagggacgtgggtgaagctggaaaccatcattctgagcaaactatcgcaaggacagaaaaccaaacactgcatgttctcactcataggtggaaattgaacaatgagaacacttggacacagggtggggaatatcacacccctgggcctgtggtggggtggggggagggatagcattaggagatatacctaatgtaaatgctgagttactgggtgcagcacaccaacatggcacgtgtatacatatgtaacaaacctgcacattgtgcacatgtaccctagaacttaaagtataataaaaaataagcaagtttacaagggcaaaaataaaacaaaaaagaaaaagcaccacactgcttccacagtggctgaactaatttgcactcccaccagcagtatataagtgtaccctcttctccacagccgtgccagcatctgttatcttttgactttttaataaaagccattctgacaggtgtgagatcatatctcattgtgttttaatttgcgtttctctagtgagctttttccatatgtttgttggtggcatgtgtgtcttctcttgaaaagtatctaaaacagtcacttatcttttaaagaaactttttaaatcagaaaaaaggtgtttatatttaaccacgtatttatcatttgcagtgctgttcattctgtttcttaggtcaaaatttctatctggtatcattttcttctgcctcaggcacttccttttattatactgctgatctgatgctgattaattctttcagtaggtgtatgttttcatagctttttattttatctttgtttttcaaagatattttgaagagtatagaattttaggtagacaggccgggcgcagtggctcacgcctgaaatcccagcactttggaaggtcgaggcgggcaggtcacctgaggtcaggagttcaagaccaacctgaccaacatggagaaaccccgtctctactaaaaatacaaaattagccaggcatggtggtgcatgcctgtaatcccagctactcgagaggccgaggcaggagaatcacttgaacctgggaggcagaggttgcggtgagccgagatcgcacaattgcactccggcctgcgcaacaagaaagaaactccgtctcaaaaaaaaagaattataggttgacagtattattctttcacatccttaaactatgttgttccactgtcttctgatttgccttgtttccaagaagtcacctgtcaatctaatctttgttcctctgtatataatttttttttctctctagcagcttttcagattttctcttcctcactcgttttaagcaatttgattatatggatattagcatagtttccttcatgttgcttgtgcttggggttcatcgagatccttagatctctgggtttatatatttagtacgttttaaaactttttggccattattttttcaaatatattttctgtccactcctcttcatcttcttctggaaccccagttgcacatatatttggctatgtgaaatttcctacagctcactgatgacctgttttttaaaaaatcttttttttctctttcattttggaaagttttattactgtgtctgcacgttcaccaatatttttgtctgtagtgtctaatatgttcttaattccatctagtgtattttttcctcttagacattgtaatttgcaatttctatagatttgtttggggtctttttttttcatatctgccatgttactccttaacataccaatgctttcttctttttctgatcatatggaatatataatagctattcaatgtacttgtgtacaaattctgtcttctggatctatttttgtttagtttttgtcctaattatgaattatatttttctatttctttccatgcctgttagttttttattggatgacaggtattttgaattttgtatcgttaagtcttggattcctttttttttttttttttttttgatgtgcttttaaatacgtttgaggattgggatgaagttaaatttgggaacagtttgatttttttgattctttctaaacttacttttaagctttatcagagagaccagagaaacctttactctagggttaatttgacatcattgctaaggcagtacctttctgaattttcaacctgatgctccatgtattacaagatttcttgaactattccagccccatatgtgttacaataatttttctgcctccacctctgtggtggttcttttcccagctttgacatatttcctcacacacagcactcagctgaagactccagtgatctctgagtgtatctctgtttgcggtttcttcctttccggtactctgcttgtgagttttagcctccttggcttcctccaatatttaactgtgtctcctcaacctcagagattgccaggctctgttggggttcctccttcctgtgctgcagcctgggactctttaggcattaagccagagtaattacagggttcaccttatttatttcccttttcttaaagattactgttctgtgctgcctgttttctagtgtctaaaaaccatttcttcatgtattttagatatttaaggttcaaaccagtctgttttactctatcgttacctgaagcagaagactgacttctgtactgtttcatttgttaaccagagtaaatccttcattattcacataataaattaataaggatgatgtttttctcacagggactagattaggcaatatacatgaaaagcatattattgacagtaaagtgtaagatgctacacagatgtttatcattgctattacaaaggagataaccccgttttcctgcagttagggaagttctatatgggagtaaggctgaaagggccaaaagatataggtattgtttctgaaaaactgcctatgcttctatgcatataagtatgtcatgttgcatatttttctgtgctgtattaattcatgcattcctttatcaacagatacttattaaacactcatatgtcaggcattgttctagggactagagatctctgccttcaaggagcttattttctagtggtatattttctgttctgtgtcttagctatccacttttttcatctgcctggacacgtgacttattctgtctctgggcctctggtatgagtgctcatttcattctgccttataactcctattttcttccctactttatctgaccttcctaccttagcttgttcattctttccttcaatccagttgtcatgaaatctctttctttcctctactaattttttttttctttctttctttctgagtaaaagccagagatctggccccctgcttacctctctgaattctttacttacttctgacaacttgctcatttcactccagctacattgacctccttgcctttgttgtgttttgaaaacaccggcgtggtcctaccgcaggaattttgtacttactgttccttttgccacattcatcattcatatgttcatgtcttccccatcgcttccttcaagtttttgctcagttgtcatctttttactgagtgtccttcctgacctctccctactttaaaatgttatgcttttttctactacctctcctgttcctcattcctaccttatttttctggataacacttattgccttctaaattgtatcgtataatttacttctttgtttcttctccgttgtcacactagcatataaattcagtgaaggtagagattcttttactgctgacaaaagcatctaggacatttcctggcactgataaggatctgcataaatatttgttgagtgaatgaatctccttggtaaagtccttttttgtttgcctgttatatttattgaatagacttctttgtttcatgtactttaatttcaaaagtgaatggctggaacattttatatattttcttataaatcattttcattgctttttaagcttatcacatattttgttttataaatatgtagccttcgtgagataaaagattctccatccctgtttacgtgtatacttagatgacaactctaatggtcataaataattccaaccttatagataactcaggagaagatgagattataagtagactttaaatcccattcagaaacccaaggacaattcaaaaggaaaataatcattccaaatataatattcttcttattcttaagaagttgttagtattttgaattttgaatttttaatacagctcccatagaaaatactttaaaatgaacccggtaagacttcctcattaagacatatagacacatatgctcccactcccgtaatcaaatttggaagtcaaataagctctgaaaaccaaaacattcttccaagtttattgcagactcatttggtagtaaaaaccaatctgacctgatgtgtagctgtttatagtctttatttttccatttggtgagtccaattatatatttcgctgaggaaatactaacatgtttgactacattgtgtgccccagacctgcttagagtattatgtaatatgcagtataggccatatattgcctttttaacatcaaaaataccctaaattctgaaatgcatgtagccccaagagatttgtataaagcattgagggcctgtgtatttttttttaatttacaagtgaagccagattccctagacattaagtgcctaacttttggttgttgttgctgctgctgttactgttttttctccagcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggaggtaagcatcattttcctggccttgatcctccaaggggtccaggctttggttttcatctgtatgaattatatgttcatctgcatcccttccagtctctaccccacactgctgtcaccttttccttgctcagaaacctttgatggcatcctgctacttctaggataaaaactatagctccatagcctgtcatacaaagccctgcttctctggccccagcaactttcagcctcatctccagcccaccttgcatcctcctctcgccatctctgctctctgaataactgaggcatatttatacctttgtatgtgtcttcctttaccaaaaacaccccaccgtttccatttcaccctctcgaaaaccaatgcagaaatcaagactttgtctaaagaacacctctgttttaccttccccaactcaccttattataaggcatttttctttctttgggctctgcagacacattataaactattatctttatcataaaaattgtatgattttccattttcttgccttttctcaaatttttttttcaaccccattccctgtcccaccacatgccccatttctacttttgtattttgtcctttactctggccgtccagtcgtcatctgatactcatgtgattcaaaaccgattatcagttttccactaaatatactccatcttctgatacccagactcaaaaccttcccatcctcactgactccccctcctcgcctgtgctgcgaggctgtggtccagccattccgtgctctctggcattccacactacattccattttcattgttccacttatagtagtcttctccctggtctctgtccctccccacttctaatcaagtttacatcttgtagccagatagatattactgaagttctgtatcttgttgctgctccgtgtctccgttttgcctacaaaatccaaattctgtaagttggctttttggatctcccaagagctggcctcaggctgcatttccaatctatttcccgttttgccccttcaggtcaaagtctactacttggtaggagcaccatgatttctcactttcctgccttggcacattctttctatttttgctctctcctcttcctggaatgcctttatccactctcttatatgaatgtgttcaaattctgccaccttttcaatattcagagcaaatacctcttctgctccaaagccctctgaactctctccttctttgaaatcccacatcacttcatttgtagctctcttgtagtacttgtctcttgaatcactaccttttatgatattatagcttaattatgactatatccatcagcgtgaaaactccagcaggagggaaggaaacagatgtccctgagtcattcagttccttcagaagttgtttttgagtacctactatgtgccaggctgtctgcttggcactgtggaatgagctcactccctgtgcccaagcagctcttggaataatttgcacacttctcaatacagctggtgcctagtagggttattcaattccattccatcacatcctgtgtgcctttaactcttactgtagagaggaaagggaaaggtgggggaaggacaggagaggagggaggcgatctgatacacggaagagagtttttactgtaatccggagaaaatgcaggtcttctttgatgcctttcatattggatgacataaatgagactgtttttaacactttattagcaatatgaagagtttcaaaagaggaaaaatgggtttttattgtaagtttacattatttgggctttataaaagcatggtcttttaaatgttcacacttccctgggcatgaatggactgtgctgtatggccctagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtagtgagtacttcacttccaacagggggcacaccaagaatagacttccagccctgccctgccatttacttgctagctgagtcctggggaaggtaacttaatcactttaagcctcagctttatcatctgtaaaatgtgaataggaaaatctagcttgaaaggttgatgtccaggttaaatgaggtattttaagaggggctcaatacatgtaattctttttcctttgatgtacattttttagtcttttacatgaaatgtcacatctcatcttatttatgaatgtcttgctataaagatatatggttgatacttttagaagggagaataatcccaattttctttggtggtggggggactctggaaaggagtttataaaagacaactattattcttacccattttctttcccatatgttactagctttatcaagagagaaacttgaagttaaatgaatgagtagcatagacagcatgtgacttcaaaatcctatttcaagccgggtttggcgtcatgccctgtagtctcacctacttgggaggctgaggtgggaggatatggagtttcagcccagcatgagcaacataatgagaccctatctcaaaaaaaaaaaaaaatatatatatatatgtatatatatattaatttatagttcctaggactttttaagagttttacagtaaccttcagcatttaccatgcaactttcttgtttgattatgcataggattgattagacaggtattttcaaaaagcctgcaagcatagtactcagactcattgaaagtttatagaatttggcctgtgtggaaaactctgtgctccaagtacaacaactaactgaattctctaatttaaacaagtttgaagggaagtgaaaggttataaaatgatacagactcataccgcagaatcaccttaaaatgcagctgttggagaaaaaaaaaaaggaagctttatgctattaccacaagaaagttttgcctcttcaccacacagaatcctaatttagtttgggaaaaagaaacataacatccccattttccttacctgtaaaataaaaggtagtaagtagtttaagaaaactgtacttttcctaaagtttttaggactcttgtaaatagaataatagcagaatcatggaaacaaatttggaattgaagtcttgacctcattgaaagcccagaaatcaattagcttggtacttcccaatacatcagaaaagctctttctctttttgtgtcagtctctctgtgttagagggagaaacaaatacctgttcctttctacctcatttgttttggtgatcataaatgacccatgcccaagaagtgttccgagaatttcagaagccattcttgttttatttactttgttagtgaaagcatgtatttaagctttgttttggtcatgtgtgctaaggggagggtcctacctaaaggactggcttgttgagctgaggattaatcatgttatttgttgtttttcccctgtgaacagaagcccccaatgcatccaacttgaaaattgtaagaatggacaggacagctggatgtgtgactggaggggaggaaatttatcttctttgtgacaaagttcagaaaggtaaatacattctgtgatctctgatctcaagaggtgtgatcttgacacactacagttctgagtgtgtctgtgagtcacatttcagcagtggacaagaaacatccctctgctgccacagaaagtcttaaaaagcatttacgttttacctcttccaaatgtaaattgtctgtgttattttttcctaagtcaactaaatcacttttagatttcccatggaagtaaaaagaaataagaaaaccgtgataattataatcagtgactttcagtatctttatacattaaaattaatatctgtactttgttaaacaaaaataaataatagcccattcttgacacacatacaaacacacacacagaataatgttttacatagtattaaattgtttttatttcttttgcaatgctttgatataacactgagagaacttctctgaacacttccacagatgtgatgtttaagaaaaggaaagaaaacagggaatacagggaaattctcagagcacatttctctcacaattttccctttgaggaaaggttcttggcgtttatctttcattagatatattacaacattgatagattagtaaaagctgaggaaaatgtgttattttctcaaactgcattctttttttaaataaaatgatagttggaaagtgtagtataatatctatttactacagggtgagcattttcaaagtaagcagatacctaactgaaaatataaataagtaaaataaatcaataaaagacatgtggcttttaaaaaaattatcatatgagattaaattctctgaggtatatagtcagaaaaaaatgggatcagattttaaagtaaacacatatatactttatccaaaaaaatttacaggccaggcatggtaactcatgcctgtaatcccagcactttgggaggctgaggtgggaggattgcttgaacccaggagtttgaggctgtagtgagctattatcatgctgctgtactccagcctagatgacagagcgagaccctgtctcaaaaaaaagaagtttacactttctctgcctacactagtgtcagccttcttccaatccactctgtccaagtaatactcatttccagattcctgggtgtacatactgtgagtaaacacaatctgagtacctttatttgtaaatgagatccttagtcattatcattacattggaatggcttagtaagaaatgtcttgtacttggcttaaagaatctcaataactaggtccagtgtagtcctacctgaaggcaaaggagattgtaagatgttttatccattcctagtatttctaaaattctacttacatagagataaaaactttgaacaaagtcaatagtgtggccctttctatgaaacggaaagtgaagccaggaagatgccaacctaagttacattgtcacatttctgtagaagtgaatagagtatttataaacatgctgaacatggagtatttataaacacactccatgactagagtgtgcaatttaagcattgcattttaattagaagggacctgattattatagtattttgaccaattactcaatatgaactaagagactattatagtgagacagtttaatagtgtgttaagagcctggactctgaaattatactgtctatgttaaaatcctggttcctccaagtactagctgttcagccttggataagtacttaacctctttggaccccagtttctcttttgcaaagtgaggataataatagtacccatctacatcacaaggttgtggtgaggatgaaatcagttaatatgtgtatatatgaagcacttagaatagcatctgccatacattaatagtaaaacttatataagttaattatttttatgtacatctatatattgaattgcactgcctcgttggattctaatattcttccaccatcgttcgtgtttctcaggattggcttaaggatggagaagcagtaaggtcaaagattaaaagaaaattcaagttaactaggtaaatctagtattctgtcattgtgaatgaaagttggggcgcattactgtggtaaataatgaaaaaagtcagtgatttgtgaagattttaaaagactgaaccttttgatcttgttttttaaaagtgtaaatagatagtaggtagaatattaaaccagttttatttttcagcatgtttataaatactatttacactatgtgaaattacacacttcaatgtgattgtttgcagatgacatccagattcgattttatgaagaggaagaaaatggtggagtctgggaaggatttggagatttttcccccacagatgttcatagacaagtaagtgatttattattattattaatccttattatttttagagatgggatctcactctgacacccaggctgcagtgcagtggtacaatcacagctcactgtatcccccaactgttgggcttgagggatcctcctgtctcaacctaccaaatatctgggactacaggcatgctaccatgcccagctagtttcttcagttttattttttttgtagagatgatgtcttgccatcttgctcaggctcgtcttgaactcctggacttaagcgattatcccacattggcctcccaaaatgctgggattataggcatgatccatattactatcatcattttatactttctgccttattgaaatttagtacttagcttccatctataaaaaagaaaaatcataaatatttaacttccataaaacagtactatttttaagactcatgcaggtcatccaaaaaagttacctactgtagagttatgggcaaggttctgttagatcgtttgctctgagatgttggcaagatatttaattgctgcctaatcccctaacccataagacagtgccccacaggtcctttaatgaaaatgtttttaagtgttctaccaaagtaattatgatgagacctattttatgatagcacctaattatgataacaccttaaaagggtgttctaggagtcatcttctaattgaagctgatgtcatcctgttaaatgaagatttcccaatggcaactgattaaatgatcagtttaatcatttaataacatgataatgctgagcccccaccttaattattattctcctatttacaagtaattgaagagtattctcctatttacaagtaattatctggattggaaacaatccagatattcatcagtaagtggccagttaaattatggtctgtccttttgatgaaatatcatgtagttattcaaaagaatgagtactctgcgaactaatatagaaagatctcagttatacagtgttaaaatattttaaaagatgggtgtagaacaaagtgtgtgtagaaatgattctatgttcatgcataaagaaattctggaaggatacctaagaaattaataacagtatttaccactggctggtacactgtaggaactgcatggatggggaacaagaatgtcaaagagaataccactgtatgcttttttatattttataagatctttatccctgtgaatatattacatagtcaaaaaatcaaactgaaaaatgcttaaatccctaacataccaccaagaactaatgtgttatgatgccaatgtaagcaatgtttagtttcttctcttcatcactggcctgtagccatctctctctttccatacccagtctttctgatgttgctctaaataatcttggaggcttttaaggctgctttggaagagaagaaagtatatgcagtgaattttataagcatgatatttacaactagaagacatttgaaatagacaaatgaaataataaagcttcgtagtacattagcatagcattgtattttgattttacagtagcaatttcataaaaatgtatcggtatagaattctgagtttggaactttctccaggacacggtgttttttagtacactgtgtctaaacattgggtataaagaaaagcataaggaatgtgtttaatgagtagcattactgcaaaaaaaaaaaaaatgtagtcctacaccaacatgtggttcttcgtatcctgcagtttgccattgtcttcaaaactccaaagtataaagatattaatattacaaaaccagcctctgtgtttgtccagcttcggaggaaatctgacttggaaactagtgaaccaaaacctttcctctactatcctgaaatcaaaggtaagtcagttgtttaaaatcttatgctcatattttattttattttatttttggtttttgttttgttttgttttgttttgagacagagtctgactctgttgcccaggctggagtgcaatggtgcaatcatagctcactgcaacttcgaactcctggcctcaaacagttctcctgccccagcatctcaaatagctgggactacaggtgtgcgccaccatgccgggctaatttttttttttttttacttttaatagaaatgaggacttcctacattgtccaggctggccttaaactcctggccttaagcagtcctccggccttggcctcccaaagtgctgggattacaggcttgagctgccatgtcttgccattgtgcttgttctgagaagaggacaagctaattagaaaagatcagttagtcacctcctttgaacagctttctagtaacaggtccctggatccatggtgcttatttttagaagagacagtagtatattattttgaggtcatggaattagtctagctttttaaaataatgttatttccaccaagcttatatgagatttagacattgagaatttgtctttgaatttgagaatctaacatttattgactaactcagagttcaagcagctgagatgaaaaaatcaggcttgctgtttaggagaatcagccagttagtcaaccagcctcaggcggtggaacagaaaacttggccaacatgcactgtgaaactatgaaaatgagtaaggcatcattctttctctcacaaaagatgctttaagaaagggcactcataggtttcttaaatagttataatgtaaattatgattttaataagtaccgaaagtgaagcatccataaaaatataagagaatgttgaagagagagcccttggtccctttattctaaagcagcctccaaaaagaaggcttcgtcaaggagatatcatttggccctcagcatttggggtatatttcagcagttgggtgttaaacagagaaggagagggttctctaggtttaagttacttgaggagcttaaagagagaggtaaacacagcgtttatgcagagggaaaaaagtgttctgagcgctcggatggacatgaaggccaatgtgggtaaggaaggccagggccaggctaaagagggctgtgaatggcagcttaagaattttgcattaattctggagagggatagccgggcctgcctaggtttggaatgatggctctgacttctttatgtcaccactgagggtaccatttaggaggcagatgatgagtcagaagagtaatgcaagaatccaagtgagaaacagtgcagttagtaaaggtcctagtgccaggaatgaaaggagatggtggacttaagagagagtgcagtgatactgtgatacagtgatactgtcaagagggcctagaggtcggaggtgtaggagagacggggagtcatagatgggtctaagactccctgaccaggaagcttgtgatgtggttgacttgatgaaaggaacaagggagcaaaagtagatttgggtgggaaaagaaggagctcagagtaaaacatgttatattttaggtccctgtgggaaaatcaagtgtaagttcttagtaggcagatcaaaaggcagaactggaactcaagagaggacagggtgagaaatttagcattagaatcatctcaaaacgagatataacaggcaccaactgagtcatcattcaaaggtatttcttaacctagagtccactgacccccaaagagtctgtggatagaaatgtactttgatatcatcagcttcttttataatcctgttttgtattttacatactgaaaaccatgattctgagaagagatccatagagttcaccagactgcagaaggggctgtggcacaaacaaaattagaaacccctcagttggagggaagtgagactgggaagggaggtcagtaaaatgattgccacggggcacccagatccttgctgaggttggaaaccgcaaaggtgcagcagcaacaagccacatgggtgggtgttgtctcctgtgagagcaagatgtgataggtaatctttgaagagggctttcctttcctagaattcgtgctgccacaggagtgtttagaaaacggttctacaagttcttgtttcttttctgaggttgtggcctctccattgtttggtcagatttgtagtgcactctatatcctggtggtttgaaaacattgtcagcacaataacttttctttcttcacatgagatttcatacaaaatcccagtgtatggacatggtaggctttgattaaaataggggtgaagggccctgccagctcggccttccgagaggctgtcccacctctccttacttccctatcaggagctgctggaggtcttttgaatgcttctgcctacacaaaatgatgtgaaaatcactgctttaatttaaacacccttctttaaaagtagacacagaagaaaaatatggataatttttttagactttctgaggaaaaaaatagatttcttctccagaaatatgtcttcaaataatgccagtttttgctaacacagagaatcatgaagaaagaaaacccaggttacctgtatgtgtatgaacctagaaacattcaaagctcagcttggtatctaggctgcctgtctccctttcccagtggtatctatgcctcagaaaagtatgttatagtgggggtatattcaggtgattactttaatgcctcgttatcatagtaggaactatccaatgcagggattagagaatggggtcacctgaaagttcaaaattgcacctgtatgcttcatgcacctaccttccaggctgtcattgatgaaaagcttcatacaatacaaagtttaagaactgtctggagaaatacttacccattgagctctgaaggaaagaatggacaacatatatatatatgaggacaacaaattacttgattctatagaaaccttctggattataaaaactcaagataataggaccaaggagaaataatctgaccaggcaatataactggtcagaaaagtagtaggccatttagcattagagtaagtagatagaaatggatccaaactgtacaacccagggaaacattgcatacatttctcagaagtcattgaacacacttttccttacccccagtctctgtagtcattccctatctcattgcctaattttatgttcttcattatttttatcaatatgtaaacctgtcttatctatttatttatgggtctattgtcttcctaccaccccgagtacaaagaatcttctttaggtcatagactatctagaacagtataagttgcatagaaaatgctcattaaatatctgtggactgacttattgattgaccagccaagctgccatccatcctcatctataaggctagtaatatgttgggtatcatcaggtaagacattatacataaatataaagcatcatacagaaccagcccggagctttgcatcctctatggtcatcaacattgtacttcacaaaaaattattggagatggttgggtccaggggagacgatcgaaataatcaagagaaggatgattggcagaggaggaagatagttgaggaactgctgtacaaaagcaaaaaaaaataaaaaaaaaataaaagagaccataatgatttttcagtctgaaagatggagattagggataaataatctttaaattatgaaaggtatggccaagataaatgcagtcacctttactggtaaactaaaacctgaaaagtgagaatgaggtacttttaaggcacatgcacagaaataggtagcaaacactaggagattatccatatttgtgaattgaactattatctaaagtcatcaactgttatgtaaagtcattgattattaaagtcactggttattattatacaaagctattttggagtgttttcaaaagaatgacagcctaacataatgaaaacatcactgcactttgagactgatcttgactccattgtgacctcagataagtcacctaacccctcctagcttcagtttcctctcctgcaaaaggagaacttgtagtaagtggctgctttggttccttctaaaataggttgatgtttcatagtacatcccatggtgccattgtcaaaagcagaccgcaaggataaatgatcccttgaatatggagtgtgaaagtctccatattcaattctgtggagattcaaacagcaggttcttttataaagcttatgtggaatgttctgtatcagtttcttgtcattggaatcttactagctgtgttataattaatattttgcccttaaaattcccattttacagtgaaatacagccaataaatatctctctgctttaaaaggtaaaatgaatacatagaaaatactaactagtctctttgctggaatccatgtcaatagataacatttatttctgaagataaataagttgcctgcttccctcttgtgtttcatatgtctgcagtgaacagtaatgagtatagctgtaaattagttatgatataaccgatggggaaattataaatctgaatctaaaacatatttgataagtaagtcaaagtttctccacttaaaggtcatccccttctagtggaagcatatttttctcaaaatttggcaaccttggttttttttttttcctgggaagtctggagatgctcagcttttaaacaactattaaagtgtactttgttaccctgctttcccctgcttcatctttcaactgcagttagatgatcatgagataatcagtaaacagagaccttctatctagccctaagatgactgaaacaaccacagaattagaaataatcgaagttctttctgaacataagcatgacaaaactgacattgaagaatcagaaatagaataattgttaagggttcagcactaatcaaaaaaaagaatacctcattgactgtatttaatttgaaaaaacgaaataaaacctccttaactgctccagcccaaaaaaagagaagaaaggtatatgatagaaaaagaagagaaagaaaaggaaacagaaaggagaaacaagaacacagtaacaccacataggcagtaacggaactcaaaagggcattggggctggtgagaagcacagatagcgagaaacagaaagatgaaaacaaaacaaaaagaaaagcaatcagaagtctcagagggcatcactgtattgtagtcaaatagtggtcttagacttttagccccagtatctcatcagtcaccagaggttacagatcccttggttactgtttttctggcatccaccccatttttattatcctggtgaccactaaggaatgggcctccatcacttatgtccgcattgtctctgcctctcactttaactctttagtatgtcccacacacacgtaaaagatgaacttcctaaaataccatcccctacacattatttccctgttcaaaaacattcagcagctttcttgcctgtaagttcattctccgggtgctccgcagtgttgtcccaaacagttccatttctcaggaattccttatacagtcatagcttgtttctttatattttgcaaatactgtgatttttacaaattgaaggtttgtggcaatagtgtcaagaaagtctattggtgccatttttcccacagcatgtactcactttatgtctctgtgtcacattttggtaattctctcaatactcgaaacttttccatgattattatatccattatggtgatctgtgaacagtgatctttgatgttttgggggtaccacaagaagtgtccatgtaagatgacaaacttaatcgataaatgttctgtgtgttctgactgctctactgactggcaattcctccatctctctccctctcctcaggcttccctattccctatcacacaaccatatggaaattaggccaattaataaccttacagtggcctccaagtgttcaagtgaaaggaaaagtcacacctctcacttgaaatcaaaagccaaaaatgattaagcttagtgaggaaggcatgtcaaaagctgagataagcccaaagctaggcctcttgtgccagttagccaaggttttagtggtctgagtagaagattaaaccagccacaacattcccttttaccaaagcctaatccagagaaaggccttaactctcttcaattctatgatggcttagagaggtgaggaggctgcagaaaaaaagttggaagctagcagaggttggttcatgaggtttaaaaaagaagccatctcgataacgtaaaagtgcaaggtgaagcaacaaatgctaacagagaagctgcagcaagttatccaggagatctagttcagaaaattgatgaaggtggccacaccaaacagattttcagtgtacaagaaacaaccttccattggaagaagatgccatctaggactttcataactagagagaagatgtagaaatgcctggcttcaaagcttttaaaaacaggctgactctcaggaggttgaggtgggaggatcacttgaacacagaaggtcgaggctgcagtgagctataattgcaccactgcactccagcctgggcaacagagtgagaccctggctcaaaaaaaaaaaaaaaaaaggcagactttctcattaggagttaatgcagctggtgactttaaattgaagccagtgctcatttatcattctgaaaatcctagagctcttaagaattatgccaaatcttctctgcctttgctctgtaaatggaacaagaaaacctggatgacagcacatctgtctacagcatggtttactgaatatttttaaacccactgttgagacctactgctctgagaaaaaagaaaaaaaaaggattcctttcaaaatggtagtgctcattgacaatacacctagtcacccaagagctctgaaggagatcttttcatggctactaacagccattctgcagcccatggatcaaaaagtaattttgactttcagtcttattgtttaagaaatacattctgtaaggctgtagctgccgtagatagtgattactctgatgaatctgggcaaagtaaattgaaaaccctgtggaaaggatttaccattaaccacatttgtgattcatggaaggaggtcaaaatatctacattaataagaatttggaagaaattgattccagccctcgtgggtgacattgaggggttcaaggcttcagtgaaggaagtaacagcagatgtggtggaaatagcaagagaatgagagtgagaagtagagcctgaagatgagactgaactgctgctcatgatttaactttcatggttgaggaattgcttcttatggatgagcaaagaaagtagtttcttgagatagaatctactcctggagaagatgctgtgaacattcttgaaatgacaataatttagaatattccataaacttagtaaagcagcagcagtgtttgagagaattgaccctagtgtggaaagaagttaaaactgtggataaaatgttatcaaaacagcattgtatactatagagaaatcttttgtgaaaggaagagtgaattgacaaatttcatttttgtcttatttttaaaaattgccacaaccacccagccttcagtagccaccacccttatcagtcagcagccatcaacattgaggcaagaccttccaccagtacaaagattacaacctgctgtaggcttaggtgatcattagcctgttttagcaataaagtgtttttaattaagatatgtacattgctttttaagacattctgttgcacacttaatagcctatagtatagtgtaaacataatttttttgtgtactgggaaaccaaaaacatcatgtgacttggtttgttgcagtaatgtggaattgaacctttcaatatctcagaggcatgcctgtactaaactttcacttcagccaaacttatctactcctgttctcaaaagcaccctgtgtacatcttctttttcctcttcttatataaaactgattctgagaagcctttcctgaatttcccatccctcagtgaactcctaaaaggttttccccaaactcctagaacactgatctgcaccatgaatttaatgtatgtcctgttatagtgctgtctcactaagtctttcccccactatcttaaaattatgttggagggttcttggcagcaaagacattatgtcatgcttttttttatttccagcatttagctcattgtagatgcataataaatgttaactttttaacatgagttattttgtgtgaccaagcaaaagggtcaataattttttaattcagcatcttcaggatctttttgatggataatcaaatatttcactagttttaacaacactggggacttaagaaactgttgtagagtggatttgggtgtgtactgctctgtggtctctctggagctaactttcagccttcatacccattggaataaatataacgcttcttgaaatttaccatctcttcctctttgagtgctttctatttccctttaagatgtttaaaaataccattagaatcagtggtctttctgtggctagtggtgggaccaaatcaatcttttctcctctggtttctcttcctttaaatacagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccaggtacaaaaatacttattcttcctaaaactttttcatattggagagggtagaattttcttttctttggtttctgagcatgtctgtgagttgagtggctatgatattattgagtatattaattaaaatttcctgacaaatgtaaatttatttttcaaagaaatccatgttcattttacaatatgtaggtaatctcaaaagtcattaagaagaaaaaaaagtaccccaaagccagttatttaatgaataccttcctaaagattttggtatatttctcttttacattttttgacatagttgtcttgtttttgtttggaaacattgaaaagattgtatattatcatactacaatatagctatatattaaacatctctatatactacattgtagaaactttgaaaatacataaaatctgccatcaaaggttaactactactatttttatgtatatgttatagtatatatttgtaaattttaccctgaatacagctgtgatcatcattatgcattttattttaatccatttatttgcaatactattttactatcatttgcaccatgactgtgtgtatagagtcataggtgcaacgtttacctgagatgttaacataaacatttcctccagtaatatgaactttaagcataaattttaagcatcattttaatgactcatttcctcaagtgaacaaaccatagtataacttacttacatgtagtttcctgttttctatataaaatgctatactgaacctctgtccacctaacttttcacttattccagattacttttgtaaattagagtctttgtagtaaaattactacgtcagagggcatgacatctaatgccatctgttttcccaaagagttgtaccagtttatgcttccaccaaaaatgcctaagaatgaacagtggtggccatttttccattgaggagtcagtatgtttttctgtgctttgtttgattaagtttttttcctcaaggggttattttaatgtcttctacataggcaagtctgagtttggttggtgaccctcactattagcctctccccttcacataggagtgaaggctttctccattacaacccctccccaaatctggggtgctgtcagagttgccaacatgtaaactttaccaaagtggaattctgatagtcccatgacccccaccatgtgtcttagtcccaacagaaaaaccatgtgtgggcacaatactgtcctgtcacaccaaaggctgtgctcacctgagagacagacactaagttgtgctgagtctttgtaaaatatcttcatgatgtttcatttgttttacttgccgtttcagggtatagcttcccacactatggatttcctacttatggtgggattactttccatcctggaactactaaatctaatgctgggatgaagcatggtaagtaatgctttgttcttaataccaagaaaggaaaaaaataattaatgctaaaaagggtttttaaaatcattacttatcacaacagtattatcatcttgacaaataattgatgaatgcaaataaactaagaagatacttttcccaaaagatattatttcctgtggctagtataaactctattacttttatatattttatatatttactttgtaagtggcatgaacagaggaaagaaaagagcattgaaaagagacaacagagacctgactattcaaatattttaaacatcatcaaacttaatgtattctgtctctttttttctcaaatagtacacttctgaaatcattttgagttttataggatcggtcttttcccatcaagtcatcccctgagaagctgcagttaaaccacatgttgatagtttatattacaggtccattctagtgtacccatggaagaaataatactataaagaagtcttcccatttattgaatacctatttttgtgccaagtgcttttacatgttttaactgttatcttcatgactgctctatatggaaaatagtaactccattttgcacacaaaaggcatcaaagttcagaaatgttcgtactcactgaaggcacacagaagttagtggcagaacaagaatttgaagcaggtctcctgcagaaaagctagatgctctcatagtatctgtcagataacatagttgaacctgaaagagggtgatcaggaatggtacactggataactcccacactaaagaatgtgagtcgacaacacgtctttatgatttgctttgttcattagcattaggaaaaaactgctctgttttcaagaactttaaaaattcagctttcctgcaattcatagaagagctttatttcatttttctcctttacaaataagcaaaatgagatttaagattttagaagtatactaaaaatgatttttagaaatgagtttagaatatctccaaaacatggtatttatgatatgaccatttttaaaagaattttaaattattatttttcttttccttttgcagcaaacttgtctcttacctttatctgacctacattggaatagcgaattatcactaaatacattttactgagaaaaatctgatgtttttgcatttatcttaggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcagggtaagtgagcacacaaattacgttctgttggttggctggggaggggtcagtcctaggtgcagaaagatatctgctaatctaaagatgatatatcaatatctagtttagtgtactcttcaaagttctgtatgcctttggaaaagcatatgtcagatcattttattcacactgggatttccatttttgctctgttatctttgaatgtaaaggacagaaatttatatgtacattctccagtcataatcatgcagttttagggtattgtgagagataatcaacttcttttctggcacagataaatagagaagtatttccacaagcttaatagtcaccctgtctagattctggcttaaccgtcatactgaaatagaactttgccttaaaataggaacttttctttttatcttgtgccctctttgaagaagtaggattaggagaaaatgtacttttgcgtttactgtgaaccaatacttattagcatatgtgtcatgattctaggtcatcctagatcgtactaagaagacgtctataaaagcaaaggtagtaaatatttagagttggtggccacatgtggtgtctatcacatatgctttttttttacacccctttaaaaatgtataagccatgattagctagggagctatatgaaaagcaggccataaacaggttttggcccaaaggtcacaaatgccattccctgaccttaatggaacaaactttacaaaaacgtgagtggctcattgaacgtctctgtttatggcagagatgtgtgttttttcacacattgcctaacaagctaattgttagagattccaatgaaggattatttcaccaagatattggtgatttaaaatcatggtaaaatctaacattgtttggagattgttttccttaaaataacagataatggtcgttcccttaaaataatacatttctaaacttttttcctctaacaaatcatacacagattctttaagatcaatctctaactatatttgtcagtgacccagtgtccaattctgctttttctagtccacacaatccaaaagcattgaaagaacattttcaactaaaatgatatgtcaaggtgtcagaacactgatgctggtcagtttgtccttaagcatgccatacccataaaacaaaagtaggaacactcaactatgattgtggtcattgccttacagataacctctttctagagaaggctatgcagcttgcaaagaggcatgccaatgcccttttcgactacgcggtgacaggagacgtgaagatgctgctggccgtccagcgccatctcactgctgtgcaggatgagaatggggacaggtaagtcagaacttttgcatgataggttgtcctgggtggggaagaagaagagcatcgtataatgcatactgactagagataaaaataattgttcaaatatattgagtcctctaactggaatgatgaagaaaaataatgtgtgaataaggttaagtagcacaatttgctgctccatcctgctgctgtcatctgttggaatctgtagtagctggaggactcatctaagagtgaatctctctgggcaagaaaactaagatgtgtgtaggtaatggtactttttgaaaagccttgctttgtttattgaagtaatatttggagaattgttaagagtcctaccaaatccctgaagcattgttatcccagctgcatatttatgacagtgtactcaagaaaaagcccaataaaggcagcaacaacaacagaaagattaagagggactggtcattatttcccagttactggtttcttctctgctccctcttctgatggtcatcagtctatgactgtttcagacttttgtgactgctccagcccatatgtgggagtggaacattccaaacaccatgccttccattcttgctattactgagattgtatttgcaaagccacctggcttctttctaaaacagttctcttagtcctttcattgagacttctaaaatgatctcaaaagcctataaaaataacaagagacagcagccttcacattcaagtcaagtgccttatctaaaaccttcctaaaatagcatcaacatagagaaatccttttctgtggaagagctcttgagtgctgtgttttagacttcagtttaaaaattaaaccaagcactttaggaaagtaacaacctcagggtttcaagcagagacacctttgttctcattccttgcaacgtaaccaaggatgtggtataaccactggccttgttatacagtatgagaggaaccagtacaaccttcttggtataaagccatgaacagcagaattctttttcagggttaaataatccagttagcattcagtagcatacaaccacaagaaaaagcagttaaccaagacagtacagcagtgtttcaagtggcatttccagggacctgttaaattgataagtctaagaagatgagcacatacaggttagaaaggaagtgctgatatctgaagggaggattgttggaagggatacaaggcgaggcacatgcaagttccctcctaagacccaagcacactcacacaagccggctctcagagaggccacagatttgggacttggagagaccagaggatcctcataagagcataggtatagggcagcttttggccatcacagcccaagtctcttgttttaattcagctcgtcatatttggctaatagtttaaatcctgtggccattagtcatcatagaaaatataataaagaaaaatatataaaacttctgctattggggaaattcccataagggtgtgaggatttgagggggagggggaatgtacttctgctatgaaatgctgagcggcacatggaaattttcgagcagttttagaagtatgacctttttcttggtgtatgtgcatcatgtctatgtcagagtttaggcccttttcagaagtcttcttccagtatcacatttcaagaagcaatagtgaaaccctgagatcatccgttttaaaatatttctcaagtagcaaaatcacaatttagttttttaggctcttctgtgccggagttaatcccaagtacgatatacttgctattgctaaggaagaggcttgagtaaagtggcacctgatagcttattttagagaagatccagcctgtacctcgtgtcccagatgtagtgctgctgcgagatgctttagtgtgctctgcacctcaatctgtccatgctctggagtggtcatcttcttagacattcatctgaatgtctttagaacagtgcacatgtatcccctatgcaggattgcttaagggattaagagatggctttggagtaagacaggcctgggcttgaatcccagcttcaccacgtattggccttgactgagttatatgacgcctgcaagtctcagtttcattagctgaaaagtgaagataatattacctaactcataggattattgttatagtaaaaagacaatatatatcaaatgcttagcatagtctggtaaatcaaagctcccaacaaatagtagccactggtaaaatgattgttattgttattgttttgaattttaatagtatgttttttaataattaaaagaattacgctcctgtgagtgactttgacaccaccagtatgttcagcctcattagcgtaagctcttaagttccttctatcattcttatttttgtgcctctactgcatgctagggttgtaaggctgactcagacagaacctgccccagagatgacaggacagagaacgagaaaaatgtgtagaaaactgcagttgcataaccaagcagtaaatttgagagggacaacttgctccacctaggaggttaggaaagtattctctgaggatgtcaggtttgaactggaatataaaggatggagtaggcattgttcaggcagaagaaaggagcaaaaacattccaggcagagggaatatttgctggaatgtttgcaggagtggtgggaaatacaatcactttgtttcttcacaagtttactgcaagaattttcttccagtagttaaaagcttcactccattctccactcttgggatctggaaagatctttaaaaaaccaccacactgtattttggaggagggcagcagggctaagtgaggtaactaagtttttctgaacaattcctagtgccaggcattcattttacatagaatctgtgtgtcaggaaaagtcagggggaaaggtagagaagaaaaccgcccaaagccatggtatagaggcaggattgggatttaagcttaggtctttctgggctggaagcctcagtgtgtttatacatcaaggggtcaagacctgaatgctcccagaggccaggaaggtaccacaaataacgtagcagccttgggtaggcagttgggagggaccagtcctctggagacagcatcccacctcagattcaatgcattttatagattcaaaacattttagggccaaataaaactaggtatgagagcagattccattcttgagtctaatcacatcttgggaatcttttctttttcattaacattttagttaattattgccactgtgttttcattccagtgtcttacacttagcaatcatccaccttcattctcaacttgtgagggatctactagaagtcacatctggtttgatttctgatgacattatcaacatgagaaatgatctgtaccaggtaagcagaaatctcaagaaaacaactgaagaaaaatctgtagtttactttttcttctgttatgtttgggtgcatgttatttttagtaatgttaacagtagcaaaaacaaaaacaaacctttgtaggtaatatctaaaatcccattagttgagaatgttactttatgatgtaggatcctttgatctgtgggtataacagccatcaagccacaatgaaattcagcatcccgctgggggaaggcaaactttaaactttagaaatcaaacagttttttcatttaagagggagaaactaaagtaaaaatgtcacatctgtcaagaaaaataaagttaaaaaaagtttgaaaagccagtaatttataataattttgaagtctactgaaacataccttgacaacatccagattaaatgtatatcaaatgaagcattctgaaatcaccacacagaaaggttaaaagtttgcttgaggaggaaaaggtgtctttcaaaagcagaaagacagctccaagtgaggaaaagtgggaacaccagagttttgcccaaatcaggttttcttaggaattaattaggtgggctgaaaatacaagttgaggaactgttttttccagaggtcttccaacactgcaaagggagagttagctggagacacagcgaggccctttgatgggcatatgcagaattcagggagaggcaaggagcctgggagccacttcggcagaagcagagcttggacgttggtgatgggagcccagtgaccccagccagcctttctggctgagcgactgcactggcatgaaaccaagatggggttcggctcctgaggtttcctccttcctgcccctgattgcttttcccacctcactgtctttcccctactcccaccagtctgctgtatggggctcctgcccttgcccacttcttacctttccatttgtctccttcccttcatcgacccgaagcatcttcctcatcctccttggagagatggtttgctggttcacgtgtatctctcactccaaaactatggccaaaatcctgtgtaattatttacttagtaaagatatttgttcctgctctctcagtttttatagcagtgatgtgaatcatttctatttcctcactttaaaggaaaatgcttttattattttaaagaaaattaattaaaacttcattttctttaaaggaaattaaaatatctattttcttatttttatttccattctttaaaatgtgctttaggctgggtgcggtggctcacacctataatcccagcactttgggaggccgaggcaggcggatcatgagatcaggagatcgagatcatcctggctaacatggtgaaaccccgtctctactagaaatacaaaaaaaaaaaaaaaattagccaggcatggtggcaggcgcctgtagtcccagctactcgggaggctgaggcaggagaatggtgtgaacctggaggctgagcttgcaatgaggcgagatcgcgccactgcactccagcctgggtgacagagtgacgctctgtctcaaaaaaaaaaaaaaaagtgtgctttaaagtgcatttaaagcaaaactactaaaacgtttacatgtggctcttaatagtttttacctgtgactaggtaaaaattaataggtttcctgataggggaaaatgaccatttttcattcaatataagtcaccattaggcttcttcactggctcttgtgcttcttgtcaaaggaaaagtaaagttagtgactcttcactgcctgttaatataaaataactagtatgaagtgtgattgtagatttacatttaaaggatgtcttcttgaaactttcataccgttttggggtcattggtatccgtaaggtcattttgcctgtaaagcttgattctcgcagacttttggctgattgttccttgtagtcatcacaaatctatgaataaaaccaggaatgggacattgtagcttgtcagtcctcttttcaaaccctgcttaacagtcatattcaaggaattacttattttatgtttataaataggatctgcaaaggacacagcacaacaggattagtagctgtgatttttttttggagacagagtctcactctgtcacccagactggaatgcagtggcgcgatctcggctcactgcaacctccacctcccaggttcaagcgattcttctgcctcagcctcctgagtagctgggattacaggcgtgcaccaccacacccagctaatttttgtatttttagtagagatggggtttcaccatgttggtctggctggtcttgaactcctgatctcgtaatctgccagcctcggcctcccaaagtgctgggattacaggcatgagccactgcgtctggccagtagctatgattttttttttatatcctaaactctttactgtatcatttggttacatatgttgagactctccagtgtgttagagacaaaaaccctgaaaccgccaccattgatacttctatcccttctgatttggggactctcagaagactatacgtccatttttcccctaccttaccaccagtctgattaatgggcagtgattctggcttccctagtatgccttctaggtgtcaaacacacacccaatggcaactttgatttgagaattagaaactgctaagatttgaactcttgattatctgttgtaaaggttctctagtaactattcttaatggaaaatgatacagttctctaaataatttggattatttgacagttaagcattcttcccaaatacctttcactaatctaagtacatttctgtgaccatctgtcatgatcaaattcctctccccacccaccctctagaaacacactcaaaatagtccaagtgcaccgagttaggattttttatgaaaatattctctttaagcctttttctcctttcattctccttcccccaacatagacaaccactctatcgtgtttggtatggattgttttatttgtgtatgttcccataaaacattattggagggttttatgtatttttatgtttttaattattatacatatcatgtatattcatagttttaaaaatggtacagaagaatctacattggaaagtcaaagttgcccaccctgacaatgcccaggtctgctagcacaaatgtcactattgtgtttataggtagtttttcaagtactggatacaaatgtacgtatacttgaaatacatagatattttcatatactctcacatacaatccacattatattaaatgtacttctcttgccttgcattaacctttaaaatttttttaatttaatttaattatagattcaaaggaggttacaaaaacgtactaggaagtcctagtatttactgcaaggaaaccagaggtctcttcacccagtttcccccaatggtaacatcctgcataacctcagaacagtgtcaaaacctggaaatagacgttgatacaatccacagatcttaatcagatttcaccagttttacacacacttgtgtgtatctgtatagttctttgtgcatatattttttaaatgcctaagtggcattgtgctacatgttactgtatttctgccttcactgcttatccacacagttctacatatagctagtttgttgtttcagctcctgaagagaatctagtatgggtctttcacctataacatccttgtttcctagtagtagacatttaaccaacttctaacttcctacctcagtagataatactgcagtgactgtcctcacttatgtcctcttgtggatttgtgtcagaatttcacccagatacatctgcaagagttgggttgctgggacatttgtatatttggctttccagaatgtctgtgtaagtccccatgcccacagccatagcatgaaggtataattgtttaagatataatccttggatttaagaactagaaggtttatatcatggaaaaccattgattggactgtggaagaaaatattaaaaaaaaaaaacctctccgactcataagatattttttaattaaattcaagctacagataatttataattcctgaatggtatactatcttataatttcagatccttttttcacaatctcattctctttccttttcccatctccccaagtagcatttcagaaaacacagattagtaaacacagtttccattgacttatttttgagaagaaggctcttggcaacaatatctaaagttttgaggacatcacttcatttcaggccaggttgatagtcctagaaaatgaaagaaataagggcaagtaataatttggcaaaaaaaaagggtcttgtatagtaaataatcactgtagttgagatttagactaccctcccatcattcatcctgccagttatcatgtgctgtggtcacctacacagctaggaggttggtggctcacctgctgctgtagccagtaactgctcaatgaaaagggaattttaggcaaattgtcacaagactggctggatgtcatagttaggctcctgtgaaataaactgatttgtataaagatacattgctgttctctgtcagtgaactcagttatttgaaagatacgtttgtgattgtatttgtcttactcatttttgaaaacacacagtttgcaaaacatcttatttgcattcaccgaagtaataccttgtgggcaggatagtcaaatggactatttaagtacctattaggtatcagcagctcaccttttttattcagctgagcccccttggtgagatacttgtattatcctggttatgttatttagaatcttataataccttttatgaaatgggtgtaggaaagctatattgactggtctcaggagccagtccatgggacagtattttttaatttagtaaatttagtttccatgtcagcatagaatcatggcacttttgttaattggtttctattgagtactttatttaaatttcttcagtgaaaacatagccttaatttgatttgttaatataaaattatcagctggaggtaactcctaccagatatttaagaaaactaaatttactactaggtgtgctcaaaatcaacaatcagtgggttgtagtgagaaacaagaagctattaagacttgtaaatatgaaaataacccaccacagaaaaaattgtaagtatatgaagtgatggatttgtaacttagcctgatttaatcattttatgttgtaaacttagattaaaacatcacattgtacctcataaatatatacaattactatttgtcaattaaatttaagataaataagaattttaaaacatgaattattgaatggctaagtgttagtacagtatatgtacttcattagcatatagtatggaacaggataacttgggtgccaaggtcagaagttaatctgggaatgagaaatattcctgcagtatggccccacctattgcagtaacagctaccaagctgtgagttgtaagtaagtattcactgctgaccagtgaatctcctgccctttcactttccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtaagagacaatcacacatcattggtgtaactttctccaccttctaaatatctactaggtatttgataaacgtgtgttatttgatttgcacccaaaagtgctttccttagtcacctggagttcatcatctcttttgggcatttctgttgctcaccaaagctaatttttttaaagatgatttggaatagttagtaggaggagaaagcagaggcctgagtaaagattcatcttgaagtacacaaagcgtcgtttattcagagaatgtttatttatgttcatgtctcctgagaacataataggagactgtgggtcttcaaagcagaacaatagacttatagtatctttactgtccctccccatgattcagtttttgccatttccttcagcttcacaagggccatcttgtgagttagccatcccatcctgtgactgtccctttgcttggactctaggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggaggtgaagggcacacttatttgcttttgcattaaatttctgagggagatttaaggaaatcttttcaaagaaggaagtcagtagctgctgttctcccttacaatcagctctatttgtttaacatttatggagggcttcagagtaccacctttagacattcccccaacccccttgcttggcatctctaactggggatttcttcaatgacagagccagcccaaagtagcaattgggctagtaataggacccaaggagccatgcacactgggaggtggggacaaaagggcaaaagaaccttccactaacgctttcttgtgtgggctggattgtagggtgatgcccatgtggacagtactacctacgatggaaccacacccctgcatatagcagctgggagagggtccaccaggctggcagctcttctcaaagcagcaggtaagatggtgatctggcggtcattaatgaaaaatgttaccaggaatgcaaacccaacttcaatagagcagtcatgttgccttctttaagccacagacctactgctgaaaaacaagggtaaataaaaattatatggcaaatcacattttatctgccataaggcactgtttggactagtaatcttgggctttaccctgatagtcattttagtttttactttctgattcatctgtttgtttggggtttgattgtttagattgactcccatgacaaagggtcttttcaaagtagagtttgattccttatagaattctgagtggtattagtctcagatcatatcagaaggccccagaagaaaaagattattggtataagaaatcatttaaagacttcattttgaaagaaatatctcttagaaattgaagtgtaggaaaaagaaaatgggccatgtattaagacccattatgtggaaggcactaaaaatggctagcacttattgacctttctgtgtaccaggcactgtgatatgcactttatgtgcacagtctcatttaatgcccaatcaccccttgtgacaaataccattattccccatcttagagtcaaggaaacagactagagagactaccagatcccacttcagggttccagtaagtgacagagctatgaatcacacttcggcagtgtgaacttcaagactttattctctgtactatgtttctctctcctattttgctcataggtttgcagatgttattccatttaattctctagtcctgtgaagtatagaaaattatccatgctgatctttgaatctccagtgccttgcatatttagaacctcaaaatatgtgtaatgaaattggcatctgaagcctgccctgacatatctgatatactttagaggctttttttttttttaacttaaaaggtaaatgcttcataaattcaagaaaacaaagcaaaagacataggaactttttctttgggacaccatatttttcttttctcttttgttaaatagaactttttcttgaacaagaaactctgattgcagtgggtattaatagttttagaagacactgattaattaaatgccttccaacaagaagctataaccagccagacgtgatggctcacacctgtaaactcagcactttgagaggctgaggtgggagggtcacttgcactaggagtgtgagaccaaccaggttaacattgtaagacctcatctccattaaaaaatttaaaaagtagccaggcatggtggcatgcgcctatagtcgcagctagtttggaggccgaggtagaagtatcacttgagcctgtgagttcaagggtgcagtgagctacagtttcaccactgcactccagcctgagctatagaataagaataagaccctgtctcaaaaaaaaaaaagaaaaagaaagaaactataacccttttaaaaatgctttatattgaattctcagaatcccatgaaaggaaaagcaagtaacagtttctctgatatataaatgaagaaactcagatgaaaaaccaagtcctaatcttaatgtcgtggaaaaggtcagttaagtccgagtgtggtggctcacacctgtaatcccagcactttgggaggccagggtgggtggatcacctgagactggcagttcgagactcacctggccaacatgacgaaaccccatctctactaaaaatacaaaacttagctgggcgtggtggcatgcatctgtaatcccagctactcagaaggctaaggaaggagaataacttgagccctggaggctgaggttgcagtgagctgagactgcgccattgcactccagcctgggcaacagagcaagactccatctcaaaaaaaaaaaaaaaaaaaaaaagcgtcagttaagagatagctcatccctccacactttggtcctgtaaattgttcatcttaatttctccatggattacatttattgcctcatagatcaggccagaactgggagaataaaatcaagaaacagcatgaagatccttctttgtttcccattaagtactcctctattattgatattgacccatctgatgttctcccagcaagataaaaacaagttcctccctcaaaaatggcatcattagacatcaagctaaacactcataaaaatcatctaagcctctgagaagtaactctagctctagtctttgagttactttgatgttttgtttatttgtttgttgtttttgtttttgctggatgctaaagagcagactacatttcccaaaatatttcaataattatacatcctagtaggtttgtttatttaaagatcagaaccctggcattgctgtacccagcaatgaaactggccatgctgtcactagacatcaagcatctttgctcttttgagtgtccaagaaaaggggctgagaaatacacattgtcatgcataaatttgaacagttaggaccctaatcctgagggtgcaccctagtggctgtaatcatgctgtccatcagccctaagattaaagatgcactattcagttgagaaatatcctgtagagttaaatgtgaaagagtatttgaagtctttttttcttcaatagtatctttggctatttcaggtgtcataagacactttaacaatcaaagtaaattacaattttaaaataatttctctggatattccagtagaaatgttttatgatttaaaaattatccaggagattgcctcaagctgctacattgctttgcctttgggaatctgacctttgcaggcagttggaagttgacaagatctgggtttacctaatgctgtgtaatctaacttcgcaggagcagatcccctggtggagaactttgagcctctctatgacctggatgactcttgggaaaatgcaggagaggatgaaggagttgtgcctggaaccacgcctctagatatggccaccagctggcaggtgagtgccgctccatctgtctgatggctgcccctgagggagtcagaggttcaggaatgtaagaacagatggtcttcctggtgctttattccccaaagaacatgccttttatttttaagaaagtctgtttgtcagagaccatttttatcttgaaaaaccctatccatgaaagatctaggtcagctgagttctgagtacgaaagtgtatgcctaatcagatcagagttgagatgtgagaaaaggttagaagaaaaacacaaaattcacataaaagttacccattccaaattcacaccataattgtgaccatctcaatttctgaagctaggataaatgttactgtttgcttaggacttaggtaagtgatttcaggatgtaaaaataaactaagaattcttcttagaatttcaataaatataaacagagtaaatagatttaaagccttcctcaaaactccacagggctgagatctgaaggtataaagcagttactaggtcatttggccccaggaagaaaagccagagggaggaggtgggcagcatgcaagatctccaacatgacaagatcagttcttctagagacgagagctgctccacttctaaaactgctcatgtgcctcccacagcctgtatgtgtccagctcactgacgttagcagagactccatggttctccctttatgttagcacctcatttccccagaaggccttgccacagaacacaaaaagatgatgcactcagtgaccccacgctctccttacccaggtcagccagcaacagagtgactgcagagaacaccacaaatgcctcggcagctacagaataatttttcttttagcctaagacaattctggaccctcagttaaaatgtcagtattgccagagggttaacaccaagccttgtgaacatctagacatctcaatttgagcaagtttatacaattcattctcataagcttgttcctatggaagaagggagacagcttcacagctctgagtaagctcttcactagccttaggtctctgagcaggagatgattgacatggtggcctggactgcctgttccttccaaaaggctatagctctgactctctgcagtttggttgggtattctgacccagctcagagtttgtgcaaagcactatttcccagtaccagagcccctacagctgttcttcccccaaagggtaccatattcttggagggtggtcctgattcctcttgccattcctccatcattaggtaccaggccctcctaaggaggacatgctgagttgtttattataaagaaacagactgccctagtggtcccttcgatgtataacgatttctggtgtttttctttccaacaggtatttgacatattaaatgggaaaccatatgagccagagtttacatctgatgatttactagcacaaggtgggttgtgataaaaccagattctcttaaccattattatctccacactgtcatttaaagggaggaaccagcattatccagggtctactgttaaaagttcttatttcagaaccaaaagatgctggaggtagataaggagaatatccagttttaatctactgtaaatgtatactgccttctactcagctgggctttgaccttcaagtagagtagcttggttggttccactgggagttggacagcaagccaggcagcaatgatcagtccctccagagtgtctatggcatgttagaacaagtgtgttccttcttcatttccttcaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtaacaccttaccttacagatttagcaattttcatttgactttactctgttaacatctctggccagggcataatctccttcccttttccttaactctgaagaagaaaaccagtcattgcccaaggcctgggagggtgacccaggccaagttggcagcccatcttcctgagaatgctgttttcagataccttcagattttccccgttttcaaatacctggagacttcctgtgaaaatgctacgtagagggtcaggattttcacagaactttaacggccctgagcaaacaatcgactgtaatcaacgtgtagcttcctgtccccaagaacacaccttaccccatggcagggcattgagtcatgttctgtgaggtgactcctagtggagccattacccggggatttttttttttcatttctaaaaataaaatgtagaaaagcatggggtgaagttttctgttgaaaatttcatggttagcttttgtttctgcatggatttcagagcttcagcttacagagggagactgtgtagacgtcactgtaggcagagtttcactgcctcagcgcttctctcgctgtctctctctctgcttactacaaaccacttctctgtgatttcctgagtggtctttgagccgaaacaggaaacttgattcgaagactgtattttcttagtcgctcttctctgccctttccatttcctcctggctcctgagtggaggaggcagcatggaagagggaagggtgggctgtcagtgcttacagcctgcactgggactcgaacacaagaacatgctcctccttcctttctttctcacaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaataggtaaaaaaaaagacaaaagacagtggagatattttccagctcccccaggctggtgtcttcagctctttttggatatggtgtggcagttttctttctcgttttctggatacacttccctgtgtgtctctctaccccctgggctcaccctctgcctctcttgatagtaccattcagatgagggggtcgtacccttggaaaatcacattgacacatgaactacttagtaaacactaaataatacaataaatactaaaaacaacatgatgtgggtgattaaatttaacacatgagagaaataatatttaccttaaagagagaaccatctccttcttcctttgcctcctctctcaagcttatgacactgaccttgtcccccaccatatatgggactacgtgtcatgccaccaaaagtctcgcaaccatatgaaatggactctcaacccagcccagtaatcctatatttcctacaattttattctcccactctgtaaatgatgattccatgctttctatttctaaacccccaacactccttccctccccttactcatgcaacacccttgcttcacactctgttgaaaacagaagaaaccagaaccctctcacctttgcaccaagtgccagcccacctgtgcctgtgcccacattggcagccttccatccggacttggtgggttaaatttctttgcccagctgaggagccacctctcccctgagtctaaccccctcacctttactaggttgttgttcctgttaattcttacctctctctcctgtactagccgttcctcctccccactctccgactaggtcacctagcaagcatttcatgatttcctcatctttaaaaacaaaacacaccgaaacaatcaccctcttgatcccacatcccatttagctacagtccaattgctctattcccatacatagcagagctccttcaaagaattttttagagttattctttccagcttgccaccttccaccctctgcttggcctcctgcagttgggatcgcatccccaccgctccaccaggcctgctgtcctcacagtgaccggtcacctccacattgccagatctggtcacctccttttcaccttgaccacttgcagagtgtgtcatggttgacgcctaccttcaacttcagaccgtctccattcctggctcctccacagcacactcccctggctggctcttctacactcaccttttaaagtcacagccctccagggtcagtcctaaaccctccctgcttggtacctcacccaagcccaatactggctacatctgtcagaagcgctgccatcttccaggagattaagacaaaacccaagaattcctcaggagtcctttctgccactaatcacttcgtatgcgacgcatcgagtgtcatcctgtctgcaaccaccgccccaggccagcctgccgtcatttcctgcccaaattcttgcacggctcctactcagtccccttgtttccttcctgtccacctcccttcagtccattctctgcccaacagatggtatgattcttctaaaaaatcagtgacattgtattaattctgggttatgcccttcagttcattcagtcattcattcagcaaatcctgatccagcatacactgtgtgcctagcagtgttcgaggttttaaagataaaactgtgtccctgctttactcgtttgctttcttaaacattgctgtggaagctcttcctccacactgcgcctccattcccaagtgttttctctgctcccctggctcactagtctgaccaaccttttgactgtttcttcccattccctggaaagctcttaattggctggctctttcttgccactcagtttcagcacccatctcaccctgccagggggccttcccaggggagcaagggcagacgtcattgtccgcacttgagaaaggaataatgtatccgccggaaaacaacccagatctcctgagtcacagcccagtgctccttctgcacagatattaaaaaagaaaaaaagcaaatacttaacatttttttaaaaagtaaatacctaagcattaagcccttaatttgtagttatttttaggatatcgcatagtttgtaacccataatagacaccaaataaagattggttgattaaacaaatcagtcaataccaaaatgatagtcgtgccactggcattaaagtcttaatattctaatattggaatttggtacataagaagatagcattttgattagtgtatgttagacttctgtttccttcctcactgtataggaaataatttgtcttggtcatatccctaaggacacttataaacaaagggaattcaacctgattttccagtatagactcattttcaccaaaatcattttacttttattgctaccaaaaatgttttcaaggcaatgtatgctgtaatagcatatgaggcccagagagagatctcatttttagttcttgcttctgtcaccaatttattttgctgaggttcagcagtttccccagctatgaaatagataatacagtggttggaaaactacacttgatttctaagggaaaaaaaggtccactgtgagtcaagagaattcagaaaggattctcataaacacaagactagattgcaggaagatgtgaaagcatttggctaattctgacatttggctaataacatcctcacagtatgtcccaagtatcttctgcccttcccaccacggtgagcagtcatgacagtgagggtggcataggtgggatgtgtggctggcagaagccagtgggcaagagttgtccacagaatagtccatgagctttttagagcccggccattcccccagtgaatttgtgctttctcccctcagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctca

SEQ ID NO: 2110 - DNA, 115991 bp, Homo sapiens; identical to SEQ ID NO: 2109

SEQ ID NO: 2111 - DNA, 83529 bp, Homo sapiens
acatggtttcaaaagggtgtttactatttggccaaacaatattttttaattgtcagtcataaagtgaaatacatactaaaatatatattaaatattcaccaaatctgcattgctgctacatgaaaacattttttggtctgttggaaaatgtaattcctgagatcattgttgggctttgtcaatcattttcctcaccatcaaatcaccttaagtgacttgggagtgtgaatctaggatgttcaattttagaccaattttctctatcttctaaatgagtaaacaggctctgtcttttataaaaggtagaaaaataaccatggtgtgctaatttttttcaaggtataccatatggaaaagtataggctgaacacaaaggaagtcttttctgaatggctctcgatcacacataaggaacatatgttttccagttaatctgtccttgatgtacagcagtccagctgttgttttgcatttattaaaatattctctgctaaatagttatgtttgtctttaaaagtaaattgcataaaattacatccaatttctttctctaaaccaacatattcttcaccttcacaaagcaaacacatggtgcactgaaaccgaggtgttaccagctttacatactgttctgccatttgtgaggggtgcaaccacaacataagtcagaaaaaaagctatccagcttttcgtggaatctggtgaagtttatacttagcgataagcctctaagcctgaacttagcagggctagcaaaactttatttatttcctaactcctattattttagaatggttttcaaaataatactgcaagttcctaattgaaatacaaaacagaacaaaaagctgtgagaaatcttttttttctttggctccttaaagacttggaataatttatattagtgttgcatacattttaccttctacattttgatgtacttgctcttgaaagcactagaacaaattaattgaaataaaacctctctgaaaccatttgaatctttgatcctaccatagagttttaaaggctttcaggatataacttgtattttcccctgagtctgagtgtctacatgattatagaatgcatgtctcttgcttcatggtgatatctaatatgcatggaatactgaaaaataggtatttcccaaaggctcctatataccaggcatctcagactgacactgaaaaccttttgaagcatttttaacaacaaataatggactatttcacagactgatgccaataattagttttctggacctacagttgaaagcaaaattatctttttaactaaataggatcagcttcaaaatcctttttggagatgtttttatctattaaatgcctttattaacaacaccatcttccattttctattactccaattcgatttctcctgcatacaaggtaatgagtagaatggctgtgaatccagttaacattccagcattctgaatcatgaagaaggtgaaatcggtttttcttccagttaccttttctctcagcatatcattcatctctggaaactagaagacagatatattgttagataactgttgccatcttgtggcaaaccacaaaacagtcacttagaggcataccttggagacagtgtgggtttggttccagaccagtgtgataaagcaaacatctcaataaagcaagttacatgaattcccaggtttcccagtgcatataatagatatatttgcattatactgtagactattaagtgtgcaatagcataatatctaaaaaggcaatgtatataccataatttaaaaaaatactttattgctaaaaaatgctaccaatcattcgagctttgggtgagttgtaatctttttgctggtggagtcttgattccatcttgatggctgctgactgattagagtagtggttgctaaagatgggagtggctgtggaaatttcttaaaataagacaacaatgacatttgcaacatcaatttatttctttcatgaaagatttctctgtagtgtgcaatgctgtttgacagcattttacccacagtagaaattatttccaaagtggaggcaatcctctcaaactctgtccctgctttatgaactatgtttatagaatattctaaatcctttgttgtcatttcagcaatgttcaccaggaatagattctgtctcaagaaatcactgtttgttcctccgtaagaagcaacccctcattcattctagtttaatcacgagattgcagcaattcagtcccatcttcagtctccacttctcattctagttatcttgccatttccactacctctgcagttacttccttccctgaagtcttgaacacctcaaagtcatccatgagggttgaaatcagcttctttccaatttcaattaatgtggatattttgactccttccataaatcacaaatgttcttcatatcatctagaaggataagtcctttctagaaagttttcaacttactttgcccagatgcatcagaggaatcactatctacagcaactagagacttacaaattattcttaaatgatatgatttgtaagtcaaaactactccatggactgatccatggactgcggaatgtatgttgtgttagcaagcacaaaaactttcatctccttgtacatctccataagagctcttaggtgatttgatgcactgtcaatgagcagtaatgtttgaaaggaatttcttttatttttctgagcagtgggtcctaacagtgggtttaaaatactcactaaaccatgctgtaaacagatgtgttatcatccaggctgtgttgttctatttctagagcacagagtggattcaacataattcctaagggccctaggatttggggaatggtaaatgatcactgacctcaacttaaagttaccagctgcattagtccctagtaagacagtcagcctatcctttgaagatttgaaaccaggcattgacttctctctagtatggaaagtcctggatggcatgttcttctaacagaaggctgtttcagctacacttaaaatctattagtttagtgtagtcaccttcatcagtgatcttagttagatcttctggataactttctgcagcttcccatcagcacttgctgcttcacctgacacttttatgtcatacagatggcttctttccttaaacctaatgaatacacctctgctaatgtccagtttttcttctgcagcttctttacttctgtaagccatcatagaattgaagagagttattccttgctctgaaataggctgttgcttaacggaatgttgtagctggtttgatctttctatccataccacgtaaattttattcatgtcagcaataaggctgttttgctttcttattatttgtgtgttcattggagtagcccttttaatttccttcatcaatcctttctttgcagtcacaactgggctatctggcaaacaaagtctagcttttggcctgccttgggtttcaacatgccctcctcactaagcctaatcatttcaggcctttgatttaatatgatagatgtgcagctcttcctttcacttgaacacttagaggccactgtaggattattaattggtgtaatttcaacattgttgggtgtcaaggaatagggaggcccaaggagagggagatggaaggatggctgatcaggggtgcagggagaaaacacacacaacatttgtcaattaagttcaccattttatacgaatgtggttcatggcgtcccaaaacataatagtaacatcatagatcactgatcacaaatcactataacagatattataataataatgaaaaggtttgaaatcgtttaaaaattaacaaaatgtgacagagacaggaaataagcccatgctattcaaaaaatggcactgacagatttgcttgaggcagggttgccaaaaactttcaatgtgcaaaaaacctagcatttacaaagtgcatcaaagcaatgtgcaataaaacaaggtgctcctgtaatagaatgctgggaggggtggtatgatcatttactttggatgtttaaaggttttagtactgatagcttaataggaatatctagttctttcaggcatcaacaagagtaaaagtactgaagtagtatttttctccaactgaatcaatcagtgggatggaatttacctcattttatgttctctttctccttttccattacctgctctctatgcttcacccaacccattctttcatgacctcaagtttacccagcaaaatcttcacatctaccatcacctgtaccagaacttgtatttctctaatttttcagtggactaaatccttcacgttttaccttatatcttgctaaaacacttttgctagctaatcctagtttattctagattcctttattatcatctctcatcatatattctactttctctcttatttcatagcattttttattatttgtaattatttagtcatctgtgtgattttttgttgtttaatttaaggatcccctctttctagaggaaaagccccatgaatggaaaagccccttgaactgtgcctattttgctcactccaggatgagtattatttcttagtattatttctttaaactgaacaactctagtaagattccattcttatatcagaaagtaaaatgactataagatagcatgagacattaattttgtgacaaaagttataaatgtagcattggttctaagagatgaaatccttgctcttctgagggtctgcagagaacaacgaacagagctagacaaatataatttggaggtaagaatgcaaataaaaaactcaaattattaaattatgtatgtaatacatccagttccaaatgcaaaagaaatagtccttgattttcatacactaccatattatcattttatagaaagatttccatgatttattttaaaatgcacaggatattctctctcttacacacacacatgcacactcttttttttttagatggagtctcgttctgtcgtcaggctggagtacagtggcacaatctcggctcacagcaacctctgcctcccgggttcaagcaattctcctgcctcagactcccgagtagctgggattacaggcgcccgccaccacgcccggctaatttttgtagtttcagtagagacagggtttcaccatgttggccaggatggtctagatctcttgaccttgtgatccgcccgcctcggcctcccaaagtgctgggattacaggcatgagccaccgcacccggccatgcacgctcttttgagcacaaacacacacatacacacagatacaaagacacagacattgaacagatataaatatatactatgtcaaataactattgtcaaaattttaccaattttagtgtaccagttttagtttaacccaaaaagctgtcactgtttagaactttgaaataacaaaatgctatttactctaataagttattcctcttccaaatgtggcatagacacaaaagagggagaaaaaggagaaaaagtcctatagggacatactataacataagacaagatgtaccaaccacaaggggaatagagatagaggaaaatatctctatttcagcaaaaacaaatcatttcaccttcaaacaatacgattatgttttaaagaaccagtgaggatcagtttcaaattactattagtgtaaactactcaagtagaatgatctgttgaaatgggattgttctgaattacaacagaaaggccttccacactgcggaaagcagaaggccacccttagttaacttataatccagatactcatttccaaattttaaattaaaagaaaatacaaattttaagcttcttaccatatctgccagagaaatatagaggaacatgcctccagcaagtgcaaatataatatttggagcgaaattgttgcccaccaaaatgccaaaagctagcccaacatagcaggaacatgcagaaaggaagttgaatagcaaggcttgtcgagtgctcatccctgcattgagtaggatcacaaagtctcctagaagaagaagaagaaaatatcaagtgaatagttttttttttatttctggatgatatcaaagataatcatcaatgtccaacaaggtcttcattttagtgcatcagaaggattttaagagcatgtcacctgaaaagtctcattccactgaaatcaagaagtaagcagacttttacaatatgaacagagctccttacctaactcgtggggaaactcctcacataggattgctatggaagtactgagtccctgaaggagagacaaggtgcaggaagccccaatcgccaggccatcgatgaaattgtggagggcatcgcagagcgttatcatccaggcaatcgtccctatttctgacagtttgggccccttcaaacaggtacatgaacttggctctttttttccatcctagcagaaaatcaattaaaatgataaccaacatttcttgaaagtctcagaaatacagacaagttggagatgggttgtgcttgagaaaaacaaattgttccaacagaaagtcttttagagtaactaggaaaccctaataatatataacagagcaaagaaaacttatggttgagagaaaggaaattcatcaactgacacacctcgaataagccactaacagatattttcctttactttccctttaaaacaattcttttgacttgtataaacttcttcctactgcctttctaaaatgtagcagatattaacctaagaaatttatttatacacaagatttaaaatgaaggaagttattcaaagactaaacttaaagtcttttttatgttacaatttaaatgtgaaatccacaactagagcatgatgaatgacatcagcaacatttgttctaacccctcctatgccaccatgtgacagggagcaagttatcacagagttccttcaactgtgaaatgaagacattgtactaaatgattcatttatttatcaacaacttattgagtttccattctgttccaggtaccctgtggagggtttaggctgtaacaatatggtctctaccagctccaaagcttaattattttcttaacaaattgcatgaagtgtaaatggaacaggctagcctttacactaacacttcctttcatgtagaaacaattaaaaaatagaaaatcctgtgatggactctttgtaggaatttagatttccagaaaatttacaaaattgtacaaaatcaaatgacaaatgccaactaaaacactttccagaagttgtagaaaaagataaaatgcaaattcatttttaagtacaaaagcactttgcaattaactggagaacattttattcctaattctcctcctctcacctctacctaagcagctaatcattacatttattgaacttctgaaatttgtaaaacactctgttgaatgctataggaaatacacagaaatggaaaacacagcttctgtcttcaagaagtgtatttacattggagaaacaagtcataatatatatggatacattaaaaaaaaaacatgcaatatatatccaacagagaggggcttacttcagagcaaccatctaagaggttttacagttactccaatatcacttcaccactccaaacactttggggaccaacactttcagaatcagccttagatcctgcaatacatctctttactatttcgttagtggcaaatctgcacctttggatttttgtttgtttgtaggcacagataaaagcatttggagcaaatatttttttaattaatatgaaatgaatgggaaactgttagtaataggattcatcatcattgtcatcaccaatgtggtcgtagtagaaatagtaacagcaaaggcacatagcatttataatgtgctaggcactgttctaagcacttcaaataccgaattcatttggaacaattctatgaggaaagtacaactgttaccatcattttatagttgaggaaattaaagcacaaaaaggttggtaaacttacccagagatacaaaaaaagagtgaatgggcatttttggcaacagtgctttactactacacacatatcggggatgggaattcttctctgtaataggatctgaaggtaattcgcaaggagacttccccacctctcagaaaactcttctgaacgcttgatgcaacattgagtaagtatcaaatcttttttattttaagaaacaaagcttatccgcataaaaaattctatcttttcttaaaatgtgggctttttattttatagctgtatcttaaacgcacaacacaataaacaatcataatttagcacaggtggatcgggtagtttgcataaaaaatgccccagagcgggaagcaattacagctgaaggagaaacaaaggtggtcatagggaaagccacagaggaagtgacctgggctttgtaaaacttaatgccgtgatatacttaatgagattattttgaattaaagcagttgttttcatcttccaatctaatttgtctaattacatgtttaaaatttccttattgtgatgacttcagaagaagactacaaaaccaagtcttgactacctgatatcactacagagtctgtatacaaacacccttaattttacagaagaaattaaattaatatatcaggaatgattctcatacctctaagtacagatattattgactctatttattatgcctcatgctttggtcccaaatgatactgttgagcaggtaagagttatacatttttaatagttttggaacaaaccaaagtcagcaaaccttcacagaaacttcttttttaattcacctagaattaaatcactgagcagagagaacactaaattcaagttcctgtagttaaattagtgaatatgcctatctctctctttcctttttaaatttttgttttctattgttattgttgttcacttgcttgctttcttgtctgagttttactctaaatatgaggctatttctatcctcagccatgatgaggcaattcagcctagtgaaaagacactaagtctggaatctaaaactgagttcaagcttggctgtgagaagaattaccgtgtaatcttcagcaagacttgtaacacctttcacttagttattaatggggatggaagtcaaagcaatgtgtagtgttatcagaatgggggagaaagaatatcatgcaccaaagttaaaaaaatagagggagactatgttgaatcccaacataaattggagggcaaaaaacaaaatttttttcaaaaaaagtacttagaaattaaaatggagaaaacaaatgggcttattgcagaacagtttaaggaaggaggagaaagttgtagaggatgaggaggcctgggggaatagggagcacaaggaaagggagaagtagcatgaggaggaggaggaggaagacaagtataaggaggatgagaaggaggatgaggaagaggatgaagagaaggatgattaggaggaggacaaggtggagcatgtggagaaggaggaaaaggaaaacagggagaacaaggagaaggaaacgagcaagcatgagtaagaggagcaggaagaggactaaaaggaggagaaagataaggacagacaagaaggacacaaaggaggaggtgaagaatatatggaagagtctcttttaataagtacagaatgtgaatctaattctattccactaaatctcataaaaggccatcacagaggatagcttcagtaataaagtgaacaagaaaatctgattgtcactcagtatccttcatcaaccatccaaatgtttgcttaatggacccacatataaagcacagagtggtgcagagggaggatatatataggttcagcattctcttctcctaccagggggaatctggctttccagcactaaagaagtcccaaacttcaaaagccaaggctgatgctgagcccccaaaaagctatcactgtccaacagggcaagaggaccaggtggctgtatgtggtagcagaatgattccactggattcctcccattataaggggatgctcttggactcacaaagatagacatatacaatatatgtcttccctgccttcagtgcctctgcaagcaccatcattcatggacttatagtgcaactgatatatagccaaggtttcctgtgaaaactatctcctaaccattttttagcaaaggaagtgagacagtgggctcaatacatataattcatggatcacatcacctgcaccctctagtagcaaccagtttgacagaatgatgaaatgtcctgatgaagcctcagccagggtgcaagccaagagataacaccctgagaggttggagttctgttcataggttgggcagccaagtatatggtgtcatctctgctgtagagaatgcacaaatccaggaaccaagaggtgagagtaaaaggggtataagtcaggctcaggggctcctgccagtaatcccagcactatgggatgccaagggggaggactgcttgaggccaggtgttcaagaccaacctgaacaacataactagacctcgtctatacaaaaaatatattactttgggaggccgacacaagcagatcacgaggtcaggagatcgagaccatcctggctaacatggtgaaaccccgtctctactaaaaatactaataaaaaaaattagctgggagtggtggtgggcgcctgtagtcccagctactcaggaggctgaggcaggaggatggtgtgaacccgggagacagagcttgcagtgagccgagatcgcagtgagccgagcctgggtgacagagtgagactccatctcagaaaaaaaaaagaaagaaagaaaaaattacccaggtatggtgtcatgagcttatgttcccagctactcgaaaggctgaaggagagttacagtgagctatgattgcgccactgcactccagctgggcgacagagttagaccttgtctctaaataaataaacagataaataaagtaatctatcttatttttatgcctaatacaccacttaaagaattcttactgacaggccagatggccaagtaggaacagctctggtctgtagctcctagccagaccaacgcagaaggtaggtgatttctgtatttccaactgaggtacccagttcatctattcaggatggttagacagtgggtgcagccctctgagggcaagcagaagcagggtgaggacccaggaagtgcaaggagccggggacctccctcctggagccaaaggaggccatgaggagccatgccatgagggacagtgctctccagcccagatactatgcttttcccaaggtctttgcaacctacagaccaggagattccctagggtgcctacacctcaagggccctgggtttcaaccacaaaactgggtggttgtttgggcagacaccaagcgagctacaggagtttttttccataccccagtggtgcctggaacaccagcaagacagaatcattcactcccctggaaagggggctgaagccagggagccaagtggtcttgctcagcgggtcccacctccatggagcctggaaagctaagacccactggcttgaaattctcgctgccagcacagcagtctgaagtcaacctggggcactcgagcttggtgtggggaggggcatctgccattactgaggcttgagtaggcagttttcccttcataatgtaaacaaagcctccaggaagttcaaactgagcggagcccaccacagctcggcaaagccactgtagccagactgcctctctagattcctcctctctgggcaaggcatctctggcagaaaggcagccgccccagtgagaagcttatagataaaactcccatctccctgggtcagtgcacccacgggaaggggtagctgtgggcgcagcttccgccgacttaaacgttactgcctgccagctctgaaaagagcagcagatctcccagcatagtgctcgagctctgctaagggacagactgcctcctcaagtgggtccctgacccctgtgcctcctgactgggagacacctcccagcagggctcaacagacacttcatacagaagggctccaactggcatctgatgggtgcccatctgggacgaagcttccagaggaaggagcagacagcaatctttgctgttctacagccaatgctggtgatacccaggcaaacaggggatggagtggacccccagcaaactccagaagacctgcagaagaggggtctgactgttagaaggaaaaccaacaaacagaaagcaatagcatcaacatcaacaaaaagaacggccactcaaaaactccatctgaaggtcaccaacagcaaagaccaaaggtagataaagtcaccaagatgagggaaaaccagcacaaaaaggctaaaaattccaaaaaccagaatgcttcttctcctccaaaggatcacaactcctcaccagcaagggaacaaaatcagacggagaataagtttgacaaattgacagaagtaggcttcagaaggtgggtaaaaacaaactcctctgagctaaaagagcatgttctaactcaatgtaaggaacctaagaaccttgaaaaaaaagttagaggaattgctaactagaatagtcagtttagagaagaacataaatgatctgataaagtcgaaaaacacagcacaagaacttcgtgaagcatacacaagtatcagtagccaaatctatgaagcagaagaaagtatatcagaaattgaagatcaacttaataaaataaagcatgaagacaagattagagaaaaaacaatgaagaggaacaagcaaagaatccaagaaatatgggactatgtgaaaagaccaaacctacgtttgattggtgtacctgaaagtgatggggagaatggaaccaagttggaaaacacacttcaggatattatccaggagaacttcctcaacctagcaagataggccaaaattcaaattcaggaaatacagagaacaccactaagatactccttgagaagagcaactccaagacacataatcatcagattcaccaaggttggaatgcaggaaaaaatgttaagtgcagccagagggaaaggtcatgttacctaaaaagggaagcccatcagactaacagcggctctctctacagaaactctacaagccagaagagagtatgggccaatattcaacattcttaaataaaagaattttcaacccagaatttcatattcagccaaactaagcttgataaatgaaggagaaacaaaatcctttacagacaatcaaatgctgagggattttgtcaccaccaggcctgccttacaagagctctgaaggaagcagtaaatatggaaaggaacaaccagtaccagccatggcaaaaacaaagcaaaatgtaaagaccattgacactatgaagaaactgcatcaactaatgggcaaaataaacagctagcatcataatgacaggatcaaattcacacataacaatattaagcttatatgtaaatgggttaaatggcccaattaaaaggcacagactggcaaattggataaagagtcaagaccgatcagtgtgctgtattcaggagacccatctcatgtaagaagacacacataggctcaaaataaagggatggaggaatatttaccaagcaaatggaaagcaaaaaaaacaaaaacaaaaacaaaaacaaaacaaaaaagcaggggttgcaatcctagtctctgataaaacagactttaaaccaacaaagatcaaaaaagacaaaaaagggcattacataatggtaaagggatcaatgcagcaagaagagctaactatactaaatatatatatgcacccaatacaggagcacccagattcataaagcaagttcttagagacctataaagagacttagactcccacacaataatagtgggagaatttaccaccccactttcaatattagagaaatcaatgagacagaaaattaacaaggatattcaggacttgaactcagctctggaccaagctgacctaatagatatctacagaactctccacccccaaatcaacagaatatacattcttctcagcaccacatagcacttattctaaaagagaccacataattggaagtaaaacactcctcagcaaatgcagaagaacggaaatcataacaaacagtctctcagaccatagtgcaatcaaattagaactcaggattaagaaactcactcaaaaccacacaactacatggaaacggaacaaactgctcctgaatgactactgggtaaataacgaaattaaggcagaaagaaataagttctttgaaaccaatgagaacaaagacacaacgtaccagaatctccaggacacagctaaagcagtgtttagagggaaacttatagcattaaatatccacaggagaaagtggaaaagatctaaaattgacaccctaatatcacaattaaaagaactagagaagcaagagcaaacaaattcaaaagccagctgaaggcaagaaataactaagatcagagcagaactgaaggagattgagacatgaaaaacccttcaaaaaatcaatgaatccaggagctggttttttgaaaagattagcaaaataggtagactgctagccagactaataaagaagaaaagagagaagaatcaaatagacacaataaaaaaaatggtaaaggggagatcaccactgatccacaggaatacaaactaccatcagagaatactgtaaacacttctacgcaaataaactagaaaatctacaagaaatggataaattcctggacacatacagcatcccaagactaaaccaggaagaagtcgaaaccctgaaaaggccaataacaagtcctgaaattgaagcagtaattaatagtcttaacaaccaaaaaaagcccaggactagagagattcacagtcgaattctaccagatgtacaaagagaagctggtaccattccttctgaaactattccaaacaatagaaaaagagggactcttccctagctcattttatgaggccagcatcatcctgataccaaaaccaggtagagacaaaacaaaaaaagaaaatttcagcctaatatccctgatgaacatcgacgcaaaaatcctcaataaaatactggtataccaaatccagtagcacattaaaaagcttatccaatatgatcaagtaggcttcatccctgggatgcgaggatggttcaacatatgcaaaccaataaacacaatccgtcacataaacagaaccaatgacaaaaaacacatgattatctcgatagatgcagaaaaggccttcaataaaattcaacaccctttcaagctaaaaacactcaataaactaggtattgatggaacatatctcacaataataagaactatttatgacaaacccacagcccacttcatagtcaatgggcaaaagctggaagcagtccctttgaaaaccagcacaagacaaggatgccctctctcaccactcctattcaacatagtattggaagttctggccagggcaatcaggcaagagaaagaaataaggggtattcaaataggaaaagaggtagtcaaattatctctgtttgcagatgacatgattatatatttagaaaaccccatcatctcagccccaaaactccttaagctgctaagcaacttcagcaaagtctcaagatataaaatcaatgtgctaaaatcacaagcattcctatacaccaataacagacaaacagaaagccaaatcatgagcaaactttcattcacaattgctaccaagagaataaaatacctaggaatacaacttacaagggatgtgaaggacctcttcaaggagaactacaaaccactgctcaacaaaataagagaggacgcaaacaaatgaaaaacattccatgctcatggataaaaagaatcaatatcatgaaaatggccatacagtccaaatttatagattcaatgctatttccaacaagctaccattgactttcttcaaagaattagaaaaaaactactttaaatttcttatagaaccaaaaaagagcctgtatagccaagacaagcctaagcaaaaagaacaaagttggaggcatcacgctacctgacttcaaactatcctacaaggctacagtaaccaagacagcatagtactggtaccaaaacagatatatagaccaatagaatagaacagaggcctcagaaataacaccacacatctacagccatctgatcttcaacaaacctgacaaaaacaagcaatggggaaagaattccctatttaataaatggttttgggaaaactggctagccatatgcagaaaactgaaactggaccccttccttacactttatacaaaaattaactcaagatggattgaagatttaaatgtaagacctaaaaccctagaaaccctagaaggaaacctaggcaataccattcaagacataggtatgggcaaagacttcatgactaaaacacaaaaagcaatggcaacaaaagccaaaattgacaaatgggatctaattaaactaaagagcttctgcacagcaaaagaaactatcatcagagtgaacaggcaacctacagaatgggagaaaatttttgcaatcttatccatctgacaaagggctaatatccagaatctacaaggaacttaaacaaatttagaagaaaaaaacaaacagccccatcaaaaagtgggtgaagaatatgaacagacacttttcaaaagaagacatttatgtggccaacaaacatatgaaaaaaggctcatcatccactgatcattagcgaaatgcaaatcaaaaccacaataagataccatctcatgccagttagaatgtcgatcactaaaatgtcaggaaacaacagatgctggcaaggctgtggagaaataggaacacttttacactgttggtgggagtataaattagttcaaccattgtggaagacagtgtagcaattcctcaaggatctagaaccagaaatgccatttgacccagcaatcctattactgggtatatacccaaaggattataaatcattctactataaagacacatgcacatgtatgtttactgctgcactatttacaatagcaaagacttggaaccaacccaaatgcccatcaatgatagaatggataaagaaaatgtggcatgtatacaccacggaatactatgcagacataaaaaaggatgagttcatgtcctttgcagggacatggatcaagctggaaaccatcattctcattctcagcaaattaacacaggaacagaaaaccaaacaccgcatgttctcactcataagtgagagttgaacaatgagaacttacgggcacagggagggaaacatcacacactggggcctgttagtggggtggggggcaaggggagggatagcattaggagaaataactaatgtagatgacgggttgatggatgcagcaaatcaccatggcacatgtatacctatataacaaacctacacgttctgcacatgtatcccaaaactttaagtataataataaaaaaaaaaagaattcttgcctcctgtccccgaaaccttggacttgatgagtttgatggccctactgtccaaggcagtaattcttataccaggaaacatggtcattttctgattcactggaagtagagactaactcctggcaatttaaatttatttatggccctgaaccaacagagatgagaaagtcactataactagctagggtaatcacacctaatgatcagggggaattgattttctgctacagaatgaagacaaggacagtgcttaaaactcagggaattcagtgggatgcctcttagtactcccttcccgatagtcctggtcaagggaaaatagcaacgatcccccaataaaaacaagactaccaagcactcagatcttaaagaaatgaagatttcaattgccctaactggaaaatgactcatccagtcaaggtgatgtcagacagtaaggtaaatacagaaggtattgtcgatgggggggccctataatgagcagtttaggcctcatgaccagctccagaagtgagctgcagctataattaatgttccttaattgcatcctcttctcccaatattttatatgaagagtgttgctggggaccaatattttagtcaggttgcagtattagtaaaagacatcatgggaatgatatggtagttgatgggattttgtgcataccctgtgttaggaacatgcatttgtcaaccacatggaggacaagattggaggttgatagagagaaaagtggtagagtattcaaggtatctttcatttctccctccagatccgctttccgctcttctttccccataagacctgcaggcactctatcaaaggccctcatgtccaggtgctcagcaggttccagacagtgagctctaacaaaattggagggaaggaggagtggggatcgggatatttattcccttggctccctccttgaaggttaacttaggctggctatgtccacaactaaagatcactgttccacgtacagtagctttctacacaaaactagctcctttcaagttctagagaaccttttttcttcccttttccctttggtcataggttgttgacagctccactgttactagcctcaggttactgccctgtggttcacctacactgtgctcagagttttacaaagtgtctctcccctatttattatttatccttatttgagtaggccatctctctctggaaaggatttgacatatccaaagtctaatgctcattccacaacacaatactatgaactatatatactgttaaataagttttcatgaaaaaagtaacaaaaggattacatagacatgaatatattaaaaagagttaaacgcattctgtaaacataaagttttgataggctttgctttcattactaggttttccagtgataaatgtttgtattttatagctggtgattacttggtccttctccttacctgaaaagtcagctaactaccaaaatgaagcttcacatgagaaaagagaaattatttatcctttaatgcatgtaaccaaatataattcaaatgcacttaccttccagtcattcagtttcaggtaaagctcaaaactatttccaaaactctctttgctaattaaaataaccattaacaagaaaataacaatttctagaaacctcgcaagttgtttcctgtctctccaatcctgtggaatgtgagtaaagttgttttggtctttagtagtttaattaataatcagttattttcagtttgggaccatagcatttttactgccttgaaaagaacaatttaggagaaacctgagaggttttcaagaaatctgctactttgccaatggaatctaaagtaaataatagttaaatatttatggttatcctaatggactatttataccactctaaaaggctgcttactgttgctacagatgaggatggcattaatgcactggtacattcaggacacaggatatcatttcttataaaaagcccataaaatgtacctccccgcctacacaactctcattcttactgcaacatcttaaagggattcaggaggcaccaggaaattgtttaaatttcaatgtaagttggagaaatcagttgctaggatccttaaaagtagtgtttccaaaatataggaatatctacactgatcagcctcaaggctttcagaataattcatatgagaaaacaggggtaggatgggatgccgtggagaaaccaaccccgtgcagcagctgcctgtcatgtcttaacatttgacatgaattacatcaagaactgaaatattcaagatcccactcaatatactccatgtgactcacctgcaaaaaaagagagactgctttctgtggcagagaagatctagaaacacacggtcaaggagcttagggaaagtggtaagaggcaaagaaatagatgagaagagagattagagccagtggtaactgcaaccaccatgacagaacaggcacttaggaccaagtgggggtgataaggaataggcaaggtgccaacagagagacaaatataaagctattctctgcaaggggcaactggcaccctggtttatatttcaatagttcagaaaaacagaggctgtctctactctgtacatggagcgtgagaagtaggagccacacaagataagggtaccaggaccacattccctctgaaagctgtcactgtgccactctaaagatgtgctgacccgtttaagaaaagaagaatcgggcatgaaatatacagaatacaccactggagcacagagcagtagtgataataatatttatagtaataacagagcctcctgccgcattctcactatgctcctggtactgtcctacgcattttacatataccatcgtttaatcttcacaactgccctatatagatattatccccattttacaaatgagggaactgaggtatagaaaggttaggtaaattaaccaaagtcatacctctagaaatgtgcagaaacaggatttgagcctccatgccaaagaagctaagcctgtgatccccaggagatacaggattttattttctgtgttgttggttcctgttcacccagaatgtagtagcactgtaggcactcagtgagtgtttgttgactaaataaatgtgtagtaatattaaaagtacatcttctctcatgacatgttcacaaatcattgtcccatgaagcatgtattccagtctttccaaagagcaaacacatggacatttatgcacaacatggaaaggatgtgcataaaaaaagttcattaatcaattccaaattggttcaccaatataacataaaattcagtgcagagatgcttttgttgtttgtttgccaattcttagctactgagagttgaagaactggattaaaatctcctggcaggacaagatgtttttttcctttttggccgagaatttagcgtttaatgggtgttcaataaatattatttttaattaaatggtgggggggggtgctgaattaagtagagaaatgaaatatcaaaatacatttcagtcaatggatctcagaggcttcctcctctattctagtgatcaaggcagttttttgtttgtttgtttgtttgttttgagacggagtcccactctgtcgtccaggctggaaggcagtgacgcaatcttggctcactgcaatttctgcctccccggttcaagcgattctcttgcctcagcctcccaagtagctgggactacaggtgcgtgccaccatgcctggctaattttttgtatttttagtagagacagggtttcaccgtgttagccgggatggtctcgatctcttgacctcatgatccacctgcctcagcctcccaaagtgctgggattacaggcgtgagccaccacacccagccctcaaggcagaagacttttattggcaaccatcttgcatctaactttgtggacttacatattttttcagaagatggtttggaaagggagggcataaaagtaagaatattagcaatgaaagcagataacctgttaaagatttattgtttgcaagatgcttttctaaatgcctgtgataagtacatcatcctgattacagaggaaataaatgaggacactggaagaagggacttgcccaaaacgacacagctagaaaatgggaaagtcaggatttgtgcccagactatttgactcctaagcctatgcaataagaggtcaagatactgctcaagagaattgagtttttcagatgaggaatttctgaattaagtagcttgttgctataaggtaagaaattattattttattgctgtttgccagtctccatcctggaaggtggagtacctccaggattcaagtacctctggttttgagtagaagacactgaactaatgtgctgaggtgttctgaggattgctaacacttcacacacaattaaaataatacttccaattgttgaggagaaaaaaaacaccatcctagagctttcaaatccactacatataatctactgtttacagattgcaaaaactgattgcaaaagacagttgttttcctgactgacccgttcttagtttataacatttaataaaatgtaattttggagccaatgtcttgtattattaacactgtttaagtgttagaacacaggaatgcttactttgaagaagaatttctatctagaatgttttccaatgtcattttatacaagcatccactgtgcctacctactctgttcatctttctgttcctaaaacccactgaactgtttcctaccatagagatttctcactggctgtttcctcagccataatattattctctcggatattcacatggatggttccttcttacaattctgattttaacttaaatgtgttctccttgaggaagtcatccctgaccacccacactaacatagtgacccagacatcatcatatcacattttaattccctgcaggacattttaaaatttatttttgtattttatgtgtataaatgtatggggtacaactataattttgttacatgtatagattgagtagtggtgatgtcagggtatccatcacccaaataaagtatattgtacccattaagtaatatcttatcatgcaccctcttccctcctgctcacccttctgaatctccattgtctatcattccatattctatgtccacatgtacacattagttagctcctacttataagtgcctgcatggcatttgtaactctatgatgttgggctgtgtgtcccactagaatgaaccagaatggcagagcgcatgaacattttctgtctagtttgtcatggaatttctaaggtgtagagcagagcttggcacttggcaggtgatcactgaatagatgagaagaaaataaatgatgaaatgaatgactgaataccatcttcctacgctttaatatagcatcactgatttaatgtatggaccaggatatcattcagaatataaaatgttgtcacaaaagtagcctgatatatcacagaggcccagtttaagattgccattattgttttaatataaaagttacatgattctgggattttgatcaaagtcacaaacactataaaaattacaaaaaaaatacagactatttttgcaaaagtgatgtttgtccagaaaagaatgtttgagattctactttctaaatggaaataatctctagatttgggtgtttgtttgcaacccaggaaactataatgatggctgatccctcacttattttttccaatatatattttgtaacctggtaatagaggaggatacactagaaagcataagaccagaggccggaatgtcttatggaaccctccaatgtaatctctattggtgtttcctctgctgctaaacgtttctgacttttatccactttcactaagttggtataaaggttcgataaagtcatgttcattaagcactttgatattcctaagtagaaagagattcagtaaaataaagtctgttcttttattttacttttaatgttctgatacctgataacaaataaaaagtaataataccttaatcacttcgaaaaagaattaggctcacacattggtctctctttctacttattaggattcaaaacttctataataatacttctaaataaattgagccaataattagcatggagagcaaagttaaaggcaggagaatgtcaccacttaatttaaataaatgaagagttattaattgaattgagagccttagaatgggactgaaattctctatctaagaagcagacatatagtagaatcaaatttcactacctaatcaatgccctaactctaacccttaatacttttattaagagtcagcacttaaattgttcttcaaatatcttcaattctttttttattcactaagattattagtgaagtattaatagttataaaagtgaaatttgttatctggaaatttacctcagacacaaaactgaatagatatgattgtagagacaaataaatattatagatgagggtgtgtgtgtgtgtgtgtgcatgtgtgtatgtgtgcatgagccagtctgctaattactatataatatagtaatgtcaacctcaaaaagcagtttggcaagaccacacttcatttacaggatgcattagctttggtatctttttgatttagaatccttactttgaatatatagaataaataaaatggaataataaaatgtagagtaaattctgcctctgcaagtgcttcttcaagggagatggatttcatttattacaataaaacaccttatggtttggcaaatctttcatcatgcaatccactgagtaaaagttactcaccaggtcttgattcagtattcccaaactgcagaatgcagcatgcaaagaatagagcacaatataaatatttttaaataagcaaatagcagaagccaaagaaaacaaagtggtctattttagtcatccaacaattatgaaatggacatcctttataaggcaatcttttaaaaagctgatgttaaagactgaccagcaatagaataagtatttaaatattccattgcttcccctggtttgccactgggctttccacacagtagaataagcaattctttctgatgagcagaataatttacttgaacctcatatattattggttcatttttcaagagaaaaatgtattggcattcattattaactttttttatcaatcagcatgcatgacagaacaacacagcaattcttcattacactaatggaggaaaaattaacttgacatcaagcctaattgactaaaacctcactaattcttctaaatagggataagtcctgcttgattagtgaaagcaatttagtatagaacatgtttagatagatgcacttttattgctttccagaacttaacactaacaaactgggctctccagcatcaaaggcgagataacggtagaggttcttcacaaaacctgccacagtgtatggataagactaacacaacatatcaaacacataataacaacttggaatttctctagataattgagaagctttaggtgcaatcttgccaaaaaaattgtttcaaaagaaatttttacagatgctgccaaaatactctatagccaagcccatagcaaaataaaacaaatcataaattatcagctatgacagactggtaatcaaaactaacaaggtttcactatgcgggcaatcctcaactcactacaagttgttttacaaaagttcatttgtaagctaattgttagaaatcataacttattacagcaatattctcattaggaaattagtatcatgtatatggagcaaacatgagcttgggatgcaagaccccagaaggggacctcagcatagttttgctgtttattatctgtgtgaacttgagggagtcactgtacttaactggatcttaatttatgcagctgtaagttgacttaataccaagttcatagtgctattgtaggaatttaatataataatagctaaaaagctaccccagtgccctctactcttacccatagccatttatgttcctttttcaagtatttctctatatcagagagtattggctggcaggtcatagaggagcatcagtgagttcatgaacccctttaaattgtatgcaaaatttggtaggtctgttgcaacaggtaatgggcttcatcaagcggctgtctaagggaatgattaaaaaccattgttctatagccactttcttgaatgtttcaaaattagaaaatgacaaatgtttaaaaacaatgactggaagcactctctgcacttaagttgctgttctgcccaactgtattatcccagtaaagtcttacatatctgtcaagatggatacaagcatgattttctcagaagagcatccttgaccatttcgctttcatcatgttccatcccaatatgcgccactccatttgcatcacgtcccaccccaaaacacaccacgtctctctcaacatagtaacttgcatatgcctctactctagtactcatcacactacacaataactattttttatgtcagtaagttctagttttatatgctcaaaaatttctagtcaaataaatatgaattttttcacaaaaataaatgtatacttagattttatttaaagtagccattttaatcgatgagaagcatacaaatcaggaagtaattttgcttttttaaaagaactctgagtgtaacaaatctaagttcaaatcgttactctgatgttaaacctccctgaaattcagctttcctatctgtacaatcaagataattacacctaaatgaatgttgcatatgaataatatttacaaagtatgggtatatttcttgcacgtgacaggtaccaccagcatcacaccaccaactaccaccattattatttctattagttattcaggagtgacaggtacaggcatacctctttttcctgcacttcactttattgtgcttctcagatattgtgatttttacaaattgaaggtttgttgcaaccctgcattgagcaagtctatcagcaccatttttctatcagcatgtgctcatttcatgcctctgtgccacattttggcaattctcacaatatttcaaactttttcattattattatatctattatggtgatctgtaatcagtgattttgatgttactattgtcattgttttgggacaccatgactgtgcccccataagatggcagacttaaccaattaatgttgtatgtgttctgactgctccggtgaccagccattcccccaatttcctcccttctgtagggcctctctattccctgagacacaagagaattgaaattatgctaactaataatcctaaaatggcctctatgtgatcaggtaaaaggagaattgcatgtctctcacttaaaatcaaaagatagaaatgattaaacttagtgaggaaaacatgtcaaaagccaagatagaccaaatctaggttttgtgtgccaaacagccaagctgtgaatgcaaaggagaacttcttgaaggaaattaaaagtgctactccaatgaacacacaaatgataggaaagcaaagcagcattattgctgacatgagtaaaatttgagtggtttggatagaagatcaaaccacccacaacataccctaaagtaggagcaagcccctcttttcaattctatgaaggctgagagaggtgacaaagctgaagaagaaaggttggaaggtagcagaattggttcattgggtttaagaaaagaagccatctctatgacatagaagtgccaagtgaagtagcaagttctgatggagaagttatccaggagatctaactaaaatcattgatgaaggtggcacactaaacaccaaattttcaatgttggtaaaacagccttctgttggaagaagatgccatccagggctttcatagctaaagagaagaagtcagtgcctggtttcaaagcttcaaaggacaggctgactctcttgtttggggttaatgcagctggtaactttaagttgagaccaatgatcatttaccattccaaaacttctagggcccttaataattgtgctaaatttactctgtctgtgctctagaaatgaaacaacacagcctggatggtaacacatctgtttacagcatggtttactgaatattttcagtccactgttgggacctacagctcagaaaaataaaagaaattcctttcaaaatattactgcttattgacagtgcatctagtcacctaagagctcttacggggatgtacaaggagatgaatgtcgttttcatgcctgccaacataacatccctcctgaagtccatgggtcaaggagtagttttgacttacaagtcatattatttaagaaatacattgtgtaagactgtagctgccatagtagtgattcctataatgaatctcagcaaaggaagttgaaaaccttctagaaaggattcatcaatctagatgccattaagaacatttatgattcatgggaggaggtcaaaatatccacatttacaggagttgggaagaagttgattccaaccttcatggataactttgaggtgttcaagaatccagtaaaggaagtcacggtaggtgtacgggaaatagcaagagaattacaatgagaagttaagcttgaagatggaagtgaattgctgcaatctcatgatcaaacttgaataaatgagcagttgcttctcatgaatgagcaaacaaagtggtttcttgaaacagaatctactgctggtatagatgctgtgaacaacgttgaaatgacaacaaaggatttagaatacttcataaatgtagttgacaaagcagtggtagaggttcagaggatggcatccaatgtggaaagaagttctactgtgggtaaaatgctgtcaaacagcatgttctcgcatgtacagagaaatctttcatgaaagaagcaatcgatgttgcaaacttcattgttttaaaatacttccacagtcactccaaacttcagcaaccaccaccctggtcagcagccgtcaacatcagaggcacggccctccacttacaaaaacattagaacttgctgaaagcttggatgatcagtagcactttttagcaataaggtatttttaaattaagatatcaatgtcattgtttagacataatgacagtgcacacttaatagactatagtgtagtgaaaacatatcttttatattcactgggaaaccagaaatcatgtgacctgctttattgtgatatttactttattgcagtggtctggaaccaaattcatctgattttgacaccgactatggttcagagaatatctgagcagggacagccttccaggaggtaaagaacataatgatgtttctggaacttcatacaaagaagcagactactttcatgtgatcacctggctcccagtgcactccagagtttcaaggcatactgttctccttgtctacaacagtgtgtgattctaactagatgggccaccactctgtatctcacagctgtgtagtacatggttgagtttgtaggtgtgaagaaggtaaacgtcaacaatttggcccctgaaaatgaggacactggctcagggctgaggattctgactttctactcagcaatgtattatcatcgctagtcaacgtgaaccacattaagagagagcctattaaaagcctttcccacttttccccaaccccacagtccttcattactacttcccacctgcctgaaattgagaacatctaactcacaatccacccacaaacactttctccaccttccatcccatcttagaataagaacccttttccttttcattgtgaacagctccacttgtactctattttcattttttctctagaaatgtgctccataagatatccctaccatgacttccattctcttttgaacgttcaacctctccctgtctgcctggcctttcctctctgtcttaaatctaacacaatcccaaatcctgatactccactgaactgctcttctccctcatttttttttcacttcaatgacaaactccttaaaatagtttacttttctagtcttttcctatatctctttaccagatccagcctttcctcttctttcagctacttgcagcaaaataatgttccccagagtagctacatgtaactttagaagcattgaaaatgtatgcattctttgccaaagccttttctaaaccaaggaatgagttattcagcacacacacacacaccacacagcaacacgtcctaaatacactttggacctctcaccttacccacagagtttctgctgtccatggcagatcttcccaatctcctctttcttgaaaattattccaaaatgttctctccctaccccacaccagttctctatcttcagataaacatactatggaagatgatctattattctcattcgtctgagccagggcaatgcaaacaaagacacaccttctcaaagaaggtccaatatactagggtccacaggggttcctgtattcacagctaaaaatataccaccactccattccactctggcccctggtcattttcttctgtttcttctgttttttctttgttatgcccctaaggatgggatggcctagcacatgggactttgtccatcaagctctcttctaatgaacctgacaccaggaaatgtgttctcaggaagaagcaaagcatcaaaattcaatccatcaacagacaaatggacaaagaaaatgtggtatcaacacacaagagaatactatgcagcctttaaaaagaaggaaatcctgtcatttccttctttttaaaggctgcatattttaaaacctgggaggatactaagccaggcacagaaataaatactgcatgatttcattttcacatggaatctaaaaaagttgagctcataaaaacaaagtagaatgtttgataccagaggcctggggactgggaggaggagagatgttggtcaaaagggacagagttatacttagaaaggaaaaataagatttagagctctattacacagcatagtgaccatagttaatgatagcataatgtatagttcaaaactgcttttaaaaaagtagactttacatgctttcacaacaaaacaaatgaaaaataggtgaagtgatgaatatgttaataagtttaatttcatctttctacaatgtgtacatatattaaaacataacattataccctataaatatatgcaattattatttgtcaatttaattaattaacttctaaaaattcaatccaactgcctttatagcctttgctcaaacttgctatttgattttgttctctgcaaactgccatggaggccctgttctcttagtctattctggaagccctcatatatatcactcttggctataaattgctcttacatgaactaatccatctacttttgaatcttcaaaatgatccccattatgtcttcaagaaaccccactgcataaaatgctttcctccttccagttgataagtgcttataaatctggcatatgattcgatgactttgaaccaagtctcctactctttcaacagttgctcaatattccgtcattgaaatagaggactttgtggctttgcatctatacataatgttagatgctgtttctcttacttaatccccatcaccctcacttctcaggagcatgatggtgatgtatggttgtatggtagacacagaaataataagatttagtatttaatgcatacctactcttagtcataactttaaaaatatttcatttaatcctcataataatcctgccttgtagatattattgccagtttacagatgaagaaagtgagttttagaagttgaagaaacccgattagttatcagagtcagatttaaactcaaatctacctgactcaagtacttttgacaaagataagttgcactaatgttcatgttactaattaacacctaatgaacaatgtataattcaaaaatgacacaaattttgtgagaaaatataattattcactcatttaatttttcactctgctttaagcctccctaattctaaaagtagaaaaatcagccaagtacagattacctatatttagctgtaatatagaaaaagaaaaaagttgcaatgaaattcaacactgagaaaaatgtttcttaatctaattaaggctatttaaaagaaaaagaaaactaaagaaagcaacctactgagcttagaagcattcctattaaagttggaaacaagacaaattaccaactatcaccacttctactcaacattgtcctacgagcccttgccaataaaacaagagaaataagagttaaaacaattagaaaacaaattaaaaagggcttctttgctcttcaatatggatgcagaaagtccaaaagaataaacaaacaaaacaatactgggagaattcagcactactgcaggacgcaaaaccagtgtactaaaatcagtgtactcttacatagcagtaataatcaactagaaaacagtaggaaaaaagttatcatttgtgatacctgtggagctacaaagtaattaggaagaaatctaacagaatattttaaaaatatttctaatatagtaaattaccaaaccaaaaaatcttaaatatcataaaaatgtaagctgcagcctagttaatctctaaattcaatgcaatgtcaatgaaaatctccacaatgatattgatatggaaaaacaaagacaacttttagtgaaaaaacaaggtgaggagcagaccttgtctttatagctgactaaaaactataataattatggcagtgtggtggtaggtcagagttttgttttttttttccaaatagacaagtgaaagagactagaaagccaaaatacagatacattaatacatacaaacttgatacacggcaggaataaaatgatctgttcagcaaaagaagcgaggataactgcttatttatacaggaaaaaactggatcctcatatacaaaaataaattaaacttaaaatttttgaaagaaaatatggaaggaaatcttagtgaaaagagaaaccacagatttggagaatacatttataaatcatttaatcaaggaaaattaacatccagaatatatgtaaaactcctacaaatgacagactctttcttagaccaaatttcagttaggctcctctgaggtctcttctcaaccagaccttcgacttctgtgtccatttttgcagaattcagtcatagcaagaatcctgccaagtcagtttagcaagaatcccctcatcctttatatatgatcactcttaatatctgatcaaattcctcattccctctgactcagggaaaaatcaaataattatttttaaaaaattcttcattctccaccatccccaaagtgatatataatcaccctggcctgccttcagcaagaattccattaaattggtttagtaggaatccccctacccttgatgttttctcttaagaatattccatgcattcttcccctctctctgctaattggctataaatgccaacctgtctttactttatttagagttgaacccaatctctctccgctgttgccatagaagcaacccttattgcaacagtcttgaatacactcttccttactgttttaacaagtgtcagaatagttttttctttaacacaaatcattaagaaaaaaaaactcaactaaaaatgtgcaaaacagatgaataggaaacataaaagtaaacttatgaccaaaacgcatatgaaaagatgctcaactgcactataatcagaaagacaaatcagaaaaagataccacttcagacttattaaattggcaataatctttttaagtctgaaatttccaagtattgctaaagacaaagagaaaacaggaattattttttgctgttcatgagaaggtaaacaaacataagaggctggaaagcattttgttgttattcagcaaaattaaatgtgtgcatactccatgacccatttttacacatctatttattagataataatatatatgtatatgatacatattaatatataatataaaactttatatatgtgtttatatgtgtatatatgtaaatatatatattatatatatgtatataaaaaactattcacagagggaaaagaaaaacctaaaagtctacagattatctccagaactcaaaacttcataacattggaattgtgtttgcatggacctgaaagcacattccaaaggattaaaattataaactccacaaaaatgctgactatttaaatgtttatcacacaattaatgagaatgttatcttttcatatggatatcaaagtagtccatgactgacacccataagaaactgactgttctccaaacagagtaaatagtacagatttttgtacctttaaaagcacattcatacctaatcttatttgattatactagctgacctaagagttggcaatatcaacattttgtttgtttgtttaagatagggtctcactgttgcccaggctggtcttcaactcctggactctggtcttcagctcctggactcaagtgatccacctgccttggcctctcaaagtgctggaattacaggcatgagccaacagtgcctggcccaatgtttgttttattttttaatgaactttctgtgtaaatgttgatgccaccagcctccacaagaatggaatatactagctggccaaatgattagctaacataaggaaccagaacagataaccctagatccctcctgacattagctatcaaataaaatgcttttgtcaaatttacataacttggacaagcttttatctggggaaaagcaagtagttcttaatgtagtgttttccttccttggcaagtggctctagctggtatttcaaggctctaacagagaatcggtggtgcaaagcctgataaatcgtcatttgaatagcaaattatattggactttaagattctcttccattaagagagagtaaatgttccaaattctcttaatttatctgacaggtcaaaggcaggcttgtgggcatttatattcagaaggttgtctttattactaaattacctatgagcttttaaagtccagctttactttctagaaaatctactcaaattttaaggtagataagaaaaatgagaaagaatggaattctgtatattttaccttctcattttgttaccctaacctagaaggaacatatacaaatagattcaaacagctatgtggtttattacaagaagtcatctttttaagtgatgatctttacataattaagcatatggatttagaagctattcccaaaggtgcaaaagatgaagtgatgcgacttgatgactatgataaaaactaagaaaagacaaaaatggtaaatggaagagggagggagatgtatatttatcacaagtgtacaatgtattagacacaatgttgcatagttgacccataagaaattatttcactttcacaaaaatcagtaaattaagaatctttgctcctcatttaacagatgagcaaaggctcaaaggtgttaattattttttcccaaatcaaacaacatattttaatcctaagatgcaaacaatggcctgtgtaattccaaagcctatgcttctcttccacatccaactgccttgcaagaaaaggagactcagaagaagcaccaggaaagtattacagcagctaaaatggtgacagagcaaggatggtatcatgttaccaagaccacctcataagtaactcaacagggaggggaggggctccagcgaaaaacctgcctttatatttctagcatttagcccacaataggtactcacttacgtgttaaactataggaatggctcaggaagaaagagtgaatgaggattaggaacatagcttgtggcccacgcctgtagtcctaattactctgaaggcggagtgggagcattgcttgagcccaggtgtctgaggttacaatgaccctgtctcaaaaaaaatgaataatttaatttaattttaaaaagaggaatatcacatgctgcctagaacaaccacttacattattctaaaaatgttcagagaataggtagtgagtttagaaactgtacatgattaagcatgtacggagatgatgaggaaggctggttaacaaatggaaacaataggcagcgtagtgtaaggtaagttaaccaaacagaccaggaaacaggattcctgcacttcaatcctaatgtggtacctgtgtgaccttgggtaagttccttaccttctctgtacatcagtttccaaatctgcaagatggaaataataatcgtacttgcctcacagggttgttactgtgaagattaaacgagttaatatatgtaaagcatttaagaatatgtctaacatatatagtcttatttcagaattagccaatctttagaaaagttggacagttgtgggaaagaaggtttgagaaaacttgggagtagcagattgaggaaaaaaataacaccttgaggtagaaaagatggaacttgtttgtagacacgggaaaaggagagattcaggaaagataaatgaaaacaggccagatgtggtggctcacacctgtaatcccaatactttgggaggctaaggcagtaagatcacttgagacctggagttcaagatcagcctgggcaacatagcaagaccccatttctacacaaaaaaaatttagttagccaggcatggtggcatgtgcctgcagtctcagctacttgggaggctgaggtgggaggatcccttgaggctaaggagtttgagatttcagtgagctctgattaagccctgcactccagcctgggttatggagtgagaccctgtcctaaaacaacaaaacaaaacaaaactggaagaggccacaggaaagatgagaatatttagaggaactggccttaaaaaggagaaaggacaccagttctggcacaaaggggacagtggagagaagatgaggacccagagtagtttttttaagaagtaacagaagtaatgaggtgagacagcagagttcacacattccaaatcatcatctcagtctccttgttaaagtaagaaaataagaaataagaattttgtggagtaataaaaaaaaaactttagaacagtttttcatgaataaaagtatacttcatatcagtgaaagtaggctaaattcagtggattcaggtaccaattttcatgaccttagcaacacatagagtaaagccagataaaatgacctgtccagggcagggatgctctgagatagacccagtgagagagaaattccactaacagcaaagacaacccagaatttctcctcatgattggctatatcatctgcctctagttactgtttttatgtaagtaccagtcaatcaagatcagtggaaatcatttcttatgtcattttattatttgtatagttttctattttaattaattgttattataggggaaattaactaatttctgtttttaaatcttgtgatgttcaagaactatatgatttaaaatagtaaatggtcttttagtgaaatagtgcagaccagatatacatatttatctctagtccatcctgaaatgccctcttgaagctatgtccttataaaggaataaagacataaaactgcaaggacaggaggaaagagagacaacatgacagcattgagatttgtattttggaagatggaaagaggaaggcaagttctgactgacttcacaaagaaagtcaacaagaagcaaagtgatgcaggacccagaacctcaaaaaagttcagggattagaggcaccaagtacttctgaaggcagagggcaaagaccggaactaaacataagagaagtggctgcaagtctatttagggaacaagtagaacctcaagtccttcctcccaagccaatgtggcaaggcagccaccccaaatgatgactggagatctacccctggggaaagtgaactagagagaccctcaattcaaagacacaaagcaaactgaagacagttgggaagtacagtactaaagaaaggggtgttatgtcaaatattcttagtgccccagtccccttctcctcccactccacttcccaagtgatagccagtaatattctacccttcttcccaccgccaggcaagaatggagaaaaacacaccacccaaaagactggtagacaagccccatgcatatatgtacacacagaacttccagtcagttttttttgtatttcatacttaaaaaaaaaaaaagagtgctttccatttttctgtgcaaaatgtgtaatatttcagttatgttatggaagggtggaaagtttggaatctgtgaactctgctgtctcacctcatctgttacttcttgaaaactgctctgggtcctcatctcctctccactgtgccctatgtgccagcacttagaataatgccaagtatatgttaagtactggaaaaatacttgttgaatgaattatgtgtatttaaactctcatggaggcccaaccacctcaaaaatgttagcattctattcatagagtgtcacttcatatcagtcatcaacaaagaaaatctccctaacatctccacactttgcagctaaattctattttattgcacctcaactttacacataaaattcacaataatcaacttctaaaaatcactttatatttaatagtatctattcttaaatgaaagcacaggaaatttcataaaaagagagactgatgacagattgctggaggaacgagctccagggtccctctagtggccttgaagagctgacaccctccccaaagtaccaaacattcctcagcaatcaacatccaacaaacaccaaggctgtgtctgggctggggagccccacccggctgcagagatagtgaaatgactccacacttggctacacaggaacgtcgaagagaaaaacacaaagcatgtcacaaggtgacatgtgacacattacctagtaacaataactgaataactggggaaatagcatcttgtgcacccctctttttcctacatcttcctttttacccctctgtgacccccacttttccccaaaaagcatgcacgtgcccacacgcatgccacatagactgttgtgcctcacacttagtaggcctggagcaaaggtattaaggaactctcaaatcatttcgtctaaatatttaaaagttataatcaagctaactgttaaatgttaatatcttctattatttcactgtgataaatatgcttccatgaaaacaaaataaaaacatatgtgtaaaactatgatttttatatgactaaacacagataaaacaccagagacttctaaatttaaatattattgcttagctgagtattctgtaatgagccagaattgcttggatgaataataaagacattcctaagtcatacagtttaagtattctataacatgtctttgttctttctacatttcagcaagatcaaaaattatgcttttataatctagattttcacataatttacattctattgacagtaatgccaattagaccacctttcttaactcactgtaatttttagagagttccttattattttcaatttggaaaaactttgttgaagcagtgacagccgggattgtcaacaaaattcttaaatccatacttgtaactcaaattgaaccctgagttatattatcatgttcaatccttttaatggggtcacctaggttagattatttttataatataaaatattagaaagtattttaattttattattaaaatcactatcacttatattgtaatacttactctcttaaagcaatatccagacctacttatttcttaaatttcatttcttttgattttttgtgcaatgtaaacaaaactgaaaattgcagtctgttgctcaatttgtttaaatgtctatttatttgagactataccttcaaccaaaatagcgagaaaatagtccccataagaaattaacgtcaaaactattatctcaaggcctggtgcagggctgtcaccctggcacgcaccttctcttctttcttcagctgccttcttattcctggaagtgtatttccagaatcttagttccattattccctctcactagataggtagtttacctaggtttataattccacagttgttttcattcagaatattgaaggaattgtgccactgctctccagcattgatgtggggaagtccactaccattcagcttccaggtcccttgtgtgtgacctgtttgattattctcaaagtctttagcatattttcttccccgatatttgcatgactggttctttctcattatacaattccctactgacaccttgagggaccttttctgaacagtcaatcaaaagaagctcccacacatcactctcacatcaccatgctttagtttcatcaaggtaggttattactatatgatattttcttgttttgctcatttctatattttatgtttccattgaataaactgtaagctcctcaagaatttgcttctgaatttccagtgcctaggacaatgaacaggaactcaataaatgtttattgaataagtaaatgaaagcattactgtcataagtggaataaaaacagccttctgattttatttcaaaattatgtaaaacaggatcatgtcgagggcctcatctttgtcatggtgcttagatttactgcaaacatgtcttctgcccatagctaatcctaaatcaggagccttaaatctttaactaaaatataactttggagaagttaaacttatttgttaattatgatttaaaaaaataatttagcctctcacaaaagctgaaggctttgacagccatcctcctttctaaatataaatatgcctatcagctcattctgatactcaaggcacatttagcagctagtttatcctagtaggttcatcagaaggaactttcctgaaatcaggagaggtcacactgagtttctagtatggtcaaggaggtgatcagccctttaaatattttaaatctcaaactgtatctcttccgtgctttgtgttacaggacttgaggatcccaggggagaacttgttcaaggttggaccaggttcaaagctccttctctgtagaagtgtagccctgcctaaagttatcttgttaacgctggaaagatacaggaaaatcttccatcagagcaagaattcaagttaggctccaaatttcatggcagattatccctctgccatctggtatctaaagaattattaatcaatgtttaaattagcaatatagctgactggcacctcttgaatgacttgtcagagttcaaccacaatctcactataatccagtatttgccaaaagcttgtgtaaggcaactagaatttagacacatggtataaggaagggttttaactactattctttaggctttctctgctgtgcctcgcattaaataatatatcctcagaaagcaatatccttgggtcaaattatttttccccactacaaaaaataaatatttaacagttgatgttgtcatcttgcttacagtagagcagcaacataaggaaggcagtccagcaaagtatataagaacacaggcttcggtataaggcagccttggtactaatccaagctttgccattaggaactgagcatctttgggtttgctatttaacctctctaagtcatactctcctaattacaacagcacttgccccctaggttattaggaagatcaaatgaagtaattcatctaacgttctaggcatagtccttgagcatttaatgaatgttaattgtaattattattgtaagaaattatatacttgaacatttccagattctttgcaaactcttggctgaaagcatcattcattacactgcaaaaaataatttcctcttagctgagtgctaacacagaactggctcttcaaatacacttgagattttccttaatcaggtggagagaagcatatgaccaatcatgttttctttccagaaggaaactcaggtatttgccataataatctcttccagattgctctattttttttgctttttttccccttaactggctttcctttttattttgtttttagctgttcacttttatatcatgtttaactatatagcttgtggatctgccattcactagctgagtaaacctggaggggttatttaacatctaaagttccactttcttcatctgtcaaatgagaattgttgtagacaccagtgatactatcttttcagcatccctttttgataaccactcctctactccatccacattcccttgataccattaaaggggcccagccctctaagcacttagattagtctagaagtgatcatctaattcaagctgaaccaggaagacacttgccagagattttggatttaggactgaaagagtcaggtcaatttccttctagtagctgaaattataagacaaacctcaggaactgctagtggctatgtatcccacttatggaaaagatagcctacagtgaaagaaaagaatgatactaagagacaggaaagagaaggagggagagtcctaggggttctaatgtttcctaggttcttgtttttcctgtagcttggctgttctattagtcatctagtatctttccagtaagttgtcctttgtgcatatataattttgtttgatttctatcacttgaaaccaatatagttctaatacataagaaataatccctacactgagtagttgttataaaaagtaaatgagatcaaataattaagtgctaagcatattacctggtatatgatacgtgctcaagaaattgtgcctattaatattatttagaagatgtggatataaatataaattataagtcagacaattaataaaaacaattttaataatttgcaaatcttcttgcaatttcaaaatcaatcaaaggattatttgattctggatcttcaaagaattgtaaaataaatgctctgaataaattttgctatataatattgtataaatgcaattgagagactctcatatagtaaataatcttagagaataatgaagtccagaacagtgatccacaatttctttcttaactcacttgtttagagtaaacatatacagggaaggtggaaaaacaatgcagacttacattccagttaccccacatatataggaataagtctgacatacataaatgtacaaaaactgacttagctgcataaacagtcatgtttacacagtataaagaatgcagtataatgaaggaaaaatggaattaacatatacctgtagagataccacactgacattatcaaaatggatatgtccattagcttctgtgacagcaggatttgcatagcatgtcacaccattgatggcaggtaatgctttaggttgatgagttttttcttgaggaccaaagttatcatttccaaagtgggtatgaccattctatatgggaacaaaaaccaaagagattataagaagaaaaaagatgattcatacagacaaggaaatagagtttactgctttttatttataagaggaaaattgtatgtctattctatgtgtaaagaagtatttttagatatataaaatttctcttttttacatgtattttcatttattagattctgctgttactgtttgttcgtgttagaacacgtatacactcttattttgatgaatatgaatagaatatgaattatgcacatctgttattcaatattaaattgctgatacttgaaaaaaaacaaaaataacctccaaattttacaacatgaatcaagtatttatcttatacttgtcaatatattgactctttgttctccttaaactcacaagcctaataactggaccattctcataattctaaaaataaaatttctgtctttatttgcctatataaagtagctttagggggtaaaatattggatgttttaaataaagtccatttacctgaccatatgtctttaataacatctttagcattctttcaaaaaagaaaagtaggtaaaatccaccaaacacagcaactgccttctcaacataactgtcgactttgggatcaaatccaaatgcctaagggagaaaaaagggcaattcaagtaaaaccaagaaatttaacttgatttctggaaaataataccagtatgcaattctcaccaatgttctaagtctctcttcacatccaagtaatattggaaacttagctgccaaaaatcacaaaacaaaaactttgaaatttgaatgacaaaactgtatgagatggcacaaaaaccttacaactagaagtctcattaaataaagccaccagagaatcttacagtttcccacctataacacctacagcaatatttgccttgaaagagtaaacttttagcagtaaagcagcagctctgattctcatctttagaatacgatattaggtctagataatgaagataaatgagatattgattacctactgtctctaaaagtaatatattagtccatgatatccagaatcaaacttttaaaacaaatatggcaggccacttggattactgttttcccaagagaaatcctcttatacctacagaactgtgataaatcctaaaaaggtaaataaatcaaggcctaggcccaagaataaaagcaaaaagaagatttaaaattgccaccactctctctctctctttcacacacacacagcaataagaatggaataattctttctttaaaggacaaagaactggagttagagtttgaagttataaagagtcaagatgttcctaacagacaagacacataaacttcaaataaatagaatcagaggagagactaatgggtgaaaagccacaactttacaccattccacacattgtaaatctcccctctgaagcagaatagaagatgtctgggttcttgtcctatgtttgcctctggggagacatcatggccgcatcctcatttgaataacttctttgtgcctgtttatacaatgcaaaatggctatataaatataaatgttccatttacctaacattgaggttatgaaaataaagtgaaataagaaaaggaaaatcattttgctacaaaaaactctatgaaaatttgagagattattacaaagacagattctttatattgttaaacttcaagaaaatagaaaaccttaacatcatcaatgtagagtctttagtccacatacagtattagtttgtttaatttactttgacccataaagcagatgagataataaatacatatattatatcatattaaatgtattatgtatataatactcttttaaatcagaaaatctgtattgtcatcctagctttgttactagctgattgtaaggctataatcaaattatttaaccaccctaaattttaatattttttatctctacaattgaggctgtgaaatagatattatcttaggtcctagatcaaataatgataataaatctataactctaaaaagttatatacccactttcaatgtatagcttgaaaaattaaaggaagctttagttataattttctaaaaattacgagataagggtggtactccctgaaatactattaatattttctctctgtatggggtttgtctctccctgtgtgtgtgcattgtgggtggcagatacagtccatgtatacatatatttctctagttcccctttgtggatcccttctatgaaagtctctttctcctttccttcctcttcaacattgcctctcttttcctttcatttatttcccttcctccatttctcttccttatatgggcacaacacagatttgaaataaattgaatagtgtgcactatagtcaagatagatcaataacacattttatcaaagaaaaaaaataagttgctatttatttattagtcctcaattgatattttttccacagttggaaaaaatgaaaaggtttgtcaaccatgctctcatttactctctagtcacttataactgtagtaaatatatgagggaatttagtggtatatgttaaatacattataaatttacatttgacatttgcagtacagttgacattgcatgctctttagaaaaataaataaataaataaataatgaaacagtgtgtggaaaaattaaatttgccaagtgcaaggcagaataaagttttaaggccttctgaggtgtcccagagctgtctgagcacgtcctagtggctggcctcctagaatattaattttgtctctgatagtgatatccactgcagcttgggacaagcctttacaattgctgtgattcagctttctcttatccaagacactataaactagaccataaaacgctgtaagaattatggaggctaaaaacatacaaagtgctaaaacgttcaaaagaaacaattattcacagaaacaaatagccaacatccttacctctggaataagttggaaaattgcatttgaaaaaagagtcccaatagccagccccacaaaaaaggtcaaaatctttgggaaataagatttctttatcagtggagtcaaaatcaatccgaggagagatgccagattaataatcgtcactgacaggaatccatatccccaaactgtgggtcagagggaaaagagagtagaaattaatcagagcaaggaaccaaatgatgttttcctgtacattaagcttaaaagtgtctttaaaagcttaagacacatatcttctttaaaagaacaaaatctactcaatgaaaagtatatagaaaactgagaatacaaatatggcatagcaagcattaatagtaatactgtttatgttttaatcagccctaaatcatcattatgggattaatgagttttacagcttgcagggaaattggagaacatctagaacagcgaacagcgacaaacaatctgagatccacaggctccaagccacctagtttcatctatggctcaaggaatagattaaaacagcattttgaaaaaaaagaaaaaacaggggcagtgtgagcctcaggacaaaggtatggggtgatgggtgggagggcagggatggagatgggtcacagtgagctagcttcaaggtgaccatagctgctaacactgagtttgtcacaatcatttgtcttcagactcctgaggacagcatctcctcagagaaggtggcaccagcagcacctcaggtccccagctggagcctcctgggaatcaaagtcagtctgatgcaataagcactcaggaagtgagcacatggggcaggagggagcagctgcattacataacccaccctgtgagacacaaattaggcaaaaatattccatacagaagagatgctggtgacagaaaaaggtggtgcatctttcatctctggagacccagggcctggcacccagtaggcacacaataagtattgcttagaataaaatgaatgaatactatcctaagctctatagctaatggcatgtgtgacctattgcctttgggcctcaatttccctctctctatcttaaaggggctggtgtaaggacaaaatgggaacacaagtgaaacatacccaggacagtcacctatgtgtgggtgcaggctgagatacaacgtggcctcagggctgtgcaacatgtgactttgcctctggccccacacactgtacacaaagtacagtgtgacagaggagaaagctgcctctgcatagccacttctttaaaatatccagaaagcatgtttaaatggtgggccacttttctccatggcactgtcagtggagtacactagtaacacctacagctcagggagcatttgccatgtgccaggccctgtgctaagtgatcaacatatgtcaacttatttgaacctcacaaaaccctgtaagagaaatactactacctccttcatacagttggggaaaccaaagcagatggaattcaagtaacctgccagaatcacgcagatagaaagctggattttgaacctggacagtctggctcccaggcccacattttttagcatatgctttattattcctttagagataatctcatttttcaaaagcccaaaggactcaataaaactgtaaaaatgttttcctgaattatacatactttattaacacgagattgttcactataattattgttagtctagaatttctatgtacaaataaacaaacttagtaaatgttcattcagcctagatgacgtggaccaaaccatggctcctgccaccacacacacacaaacacacacaagtgcaaacacacacacagagtgatacaaagtcacctgtgctaagtaccaaatgaaaaggtcagattataaatggtactatgtaaccccgagaatcatcacagcactgaccatgacgactgcatcttctccagacactttcctatcagttgcaggtcctggccatgccctacaacttcacctaacagcccacttcattcccatttattaccttatcaccttaaacaatactactagtccccacagacattccacttggagagagttctcaattccacaccttttatcgtggtagatctacatggaatttctcttaacacaaacatacttctatccatcactagcctacatgccttcattcattcaacaaatatttataatctcattgggtagacaagatatatacatgttgaaaactaaaattaaaaggcaaagaaattgttaagtgccaatagaagcaaagccacatgcacatgttaaactcatcagcttccctgcaaacacctgttccattacccttgttcactacctacataaataacaggaacagtaggatcaatttcagtttttcactttccaccaattaattccatagacaactggtgatcaaaccctaccagttctgcttcaggcatctctcacctctagcctctccatcctcattgccagtggtcttgaagtcagaccctcatcacctctcactccctcatcttatataacatgacagttatcgatctggtgcccctcctactagctgacatggcctacagacttatactaaatcacaaaagtgatcatctcatgcccccatttgaaatcgcccctcataaactgacccttgcacagcctctccagtgttatttacccccttctcaacatggcctttacccaaacactatgttttcccaaccgagctttacctttacactgtggttctctgtctgaaaacactttcctatcttccttgcctaagaaagtcatacgtggccttccaagccaacacaaagatctcctctatgaagcttccctgctctccaggcagtactccctggctggtcaggattcccattactctttgttcacttaccacttcttgtgtgctacagtaattttatcactgatatatttgcctacatcatataaactgtgtgattctcaatgagaagggctatgttttattcatcctcagtgcctagaaaattgtccacgaaaaagcacacattccttgctgaatgaattgataaattccccatttcaaggtgcagcagaactctgtcaaaaagaaataccaatcgatctgcttatccaactttctaactttctttgcccttgcacatttatcagcacaacttgggggatggtgggagtgtaattcatcacattctaagcacactgcatagcttccccttcttgtattgttagaacatcattcagaaaaaaatgtctggagtttccattcaactgaagcactttccacttaactgaagcaccaaaagtatacattagtatgaatctattccttggacatctccatatatacgtgggactttctcaaacgatctgtttcagagagggaccagtctccttataagtgaaccctgaaagattttaatagatttcaaagaaatacagtcaggatagtttacatttattgactgtccactgtgtaagattcttctaagaactttacctattttaactcatttaattctcacaacaaccctatgagataggtgctgctatttttcccattttaatagtgaggaaatatggttctattatgatacccattttgcagacctgcatacagcccaggcttcaatttttgcctggccccatttaactgtgaaactgtatagaatggtgtttaacagtgtgaactctggagccagaggatttgtgttcaaatcccagctcatcccctcactggcatcataggttggttccttgacttccctaagtttcagttttctcatatttaaaatgcagattaaaatagctcctatttcatagagttattacaagaataaaataaaaccagttaatgctgtccctggaatatagcaagcctttaataaatgttgattacaattatgtttaaaaaattagtaagtagaccatgatataaatgttagttcatttaattcactgttactcagtgaaaagaagaacaaactaagaatcaggagctctcatttcaccttaggtacgacacctacaagaagccacttaacctctctggaacttggacttacatcactagttgtattacagagttggacaatatgatctccaaggatgcttcaattaatattctttattttatctactatatgaattaaatatgattctgcaacttcatcaaaaagtgaggcaatttcagaccattaaattattactaaaatgcaattaatttctctcctagagaatttaacttatcatcagtttactgtactcatcaatatcattttataaagcacatgaaatactttcaaaaataaaatgtgaggcctctgagaaattttactgtctacccactgaaatgtcaacataaatgtattcaaatttttgtatcatttggattgtttttatgttgattttttattgctttggatgagctaaagacttgactcttcattaagtgaaaagttatatgaaaaatccagtgcatttaattattttaaaatgtttttcttagtgagaaaaacaataggataacacaggggccagggaatgtggtgaacctatgaacacatgtataagaacaaagacattcttcttcctctgtgccaggcattgttctaggcacttacgtatattaactcatttgatactcccaacaattctataaaggtactattaaagtaactgacccatagagatattaaataatcatacagctgcactaaaataaaacaatcaagatatcacatcaaaaaggcaatagagtgccaagttaaacatcttagatgagtagtaacaagcactctactagtttccctaaattcccctggaaacatttccatatcttctccccccgatcccactccactccagcctcatttcaattcctaagacaatatgcaccctaagaggcatttctctttttattgggttatctgtctgaatatttggtgatcccataacttagaattgctgacttttccattttatgactttgtagtgttgtccctagaattctacctctcacaccctgcttctgacttcccagttctcaactcctggttcctgaaacagagtaacctagtcaactggggtttaaaaattacttttgaatatgagtaattaacttgcacagagcaactggggttaaaaaattacttttgaatataagtaagtaacctgcacagagtagagtatttgctttttctgaaacctcacttcctgtacctagagttatgcacgttagatgtagttatttaacagacctaactaacaggcctaccacagcacctaggtactgaataatgttcgaagtactttacaaatattaagtcatttaatctttacagcaagcccataagaaaggtactattttagatgaggaagctgaggcaggaaaaggttaaagtcatgttctcaacatagctggaaaattacagagctgggatttgagcccaggtaaactggcttcagagtctgtgcttttactgtgcaatactattagtcaagggtagtatcctaaagcgtttgctgaatttactttttaatgtaaagtgcaaactgtattaaacaggcttgtagaaatataaatatactctagcaaaaatatttgcttgaacaattagcaattcaaaattactaatatttcaaaattgaaattactgttattcacaaaattgcaaattatattgataaatgatacttggtgatttctatgctttgtatatataaatacagaatatcaatgagaacatgggttctgaagccaagacaacctgggctgaatctggctctaccacatgcaagttgtgtaactttgagcaaatgactttaaactccctgtacctttgttttcttggctgtaaaatgggaatagtagtgtctacatcatatagttgcatgaaattaatatatgaatatgtaaagtacttcaaagagtgcctgtcatatagtaagtaccacaaaagaattggctatcatcattgttatttttgtcattgttgttgttatttcttttattcatatagagggagactgaagtgtacatgcacaaaggaatccggaaatgaaaacaggcactttctttgttaagtcttcccttttcttctctatctttactctctttatctatctatactcctgtcagatgagctcactcagaacagcatctttatttttatttttttgagatgaggtctccctctgccacccaggctggagtacagtggggtaatcataggtcactgcagccttgacctcctatgttcaagtgatcctcctgcctcagcctcccaagtagctaggcctacaggtgcatgccaccatgtcagctaattcttttaacttttgttgtgatggggtctcactatgtttcccaggctggtgttgaactcctggcctcaagcaatcctctgccttggcctcccaaagtgctgggattacagggatgagtcaccgtgcctagccccagtgtctttaaatatcatctctagactggcaaatccccagtcttgacctctcctctgaaagcaatctcctctccaaatgtctgtgtgcctttgcctactggacctccctgtctacctgtgtatgtcaatgtctcaaagcaaccacgccaaaaattatattctttatcctcaccactcccttcctctacaataaagggctcttcccagtcttctccatcccgggaaatggtataacgatctctccggtttctctggctcaagacttgactcattgttccctctcccacaatcaatccagggcaaaccatttagcatgatctccaggactcatcccgaatctactgcttctccccacttctacttcccccactttagtccaagtccccatcatcctggcatcagctcctggcaatcgcttcctgaccaatcaccctgcttctactcttgccccattacaatctgttcttcagattgtaggcaggtggaatgcccttttaacagatttgaatgagatcacagcattcccctgtttagaatggtacagtgacttcacactacattcagaataaaacccaatcaatttaccacctcccgcaaggcttcctcacctggtctccatctcccgccaggacatatatccttctaccttccccaccaactcactaggctccagacacataggagcctcttgctgctcctcactcatgccaagctcattgccaagctatgttggctgtgccctcaatcaagaatgctcttcactagagacgaccttgctgtggccctctccttctgctcagatgatacctcatcagagagggcttccttgatctatctaagatgacactcacccactatcaccttctatccctcacctactaatattttattttcttcatagcacctttcactctgaaactatgttgtttatttgcttgtttaaatttgcttgtttaaatcttctccactacactgtaagccctaaaaagacagataattattcttcttgtttaccattgactccttagtgcacagaacaatacttggtatgtcgttcaataaatatttgcttaatgaacaaatgaacgaaactttaaaattccaacataattttcaaacagactccctgaacaattggtttatctcattggtgaaagtgacccttctacacatttaagcatgtgagctgtatattaagcatacatatattttattatggtttaaaatttctttgcatcagatcataccgttaaagtacatattcatggaaataccattatagtcacttaaaatagtctctggtattttctttcacctatgaaaattaaaactaataatttggtccctgaaaatttaatctagaagcatgctagttctcttatctcttcattggtaactgcagataaactgacaagctttaaaataatatggtaagcaaaagataatggaaatgaaatgatcaattataagccaaagaaaatgcaatccaatatgcacagcataaaatatatattgtttaaaatcaagaactggattttataaagtttttaagtgtactaaatgtaattttgattcaacaaagagaagagcataacttatgaagcttaaatgagttataattcttcttattccaaatactttcaaaatataagtattattcgaagaagttctatgtagattaattaaaagcaataaagcagaaaaagaggcatattaacttcatttcacaatggttcatagacttttcaaataaaagagaaaaaatgcttctaatataccttctgaatgacttggtcttgttttgtgcttgggccgatcctcacatgggtgaaagttcaattgctgtaagactgctggacagatgacagagaatttggagctggttatttgggtagcatttgaaaagccatgaagggaaaagatctcttcagcagttaaacactgaaatagaataaacaaaaaaaaaatgtgataataatgtgtaaaagcacataagcaaagatgctataaagagacacagactatttcatctagatgcacagcactctttatacaaaagcccaccacagaaattgaaaggcccctaaagttgtaaaacagcccacaccagtttaaacctagaaacaagaaaaatagaaaaaaaaaaatcccttcttaatcaacagctttcctacagcagaaaataaataagaattggtttgggcatatctaaggactttatttaaaataggggtgcaccaacaccattcaaacaaagggttttaaaacaattttttattgtcagtaccccctcttagtttacttttcttcagtttgaatggatattttgtgtgtgtcactggcatggctctctatagcatttcttgtagacaaatacctggctccctacagtttcatgctaagaaattcctctcttctctacactgcaataaatataaatataaaaagttgttttaaaatatgtcttttgcacaaactgtttttcattaaaatatgcattattctcaatgacgttgggtaacttttctatattaagttttgaaaatagtgctgggctgtttagaaattcattaactattaacaaggactagaatctacattaggaaaaaaactgcaaaaataattttttaaaggtataatgttgttctcacattttaactgtaagctcttccatatacagtacttgcattattaagaaaaatataaaataaatgctactgaatgtcataagaattatagtgtgaaaaatatccattcactcaaatggaagagtctgtctttaataaacgtaatttaggcaagttatttgcatgcttcagccaatgcttaaaccccaataagaccttagctatgtactatgatctgaattatgtctccccagattcacatgttgaagccctaatccccagtgtgatggtatttggagatggggcctttgagaggtaattaagtttagatgagttcatgaagttggggccctggtccagtgggattagtgcacttataaaaagagacatcaaagagcctgctcacttgctctttctctgctatatgaggaagcgagaaaatgctctctgtgacccaaggagagagccctcacagacagcaaccattctggcaccttggtctggacttcaagtctccaactatgagaaaataaatttctgttgcttaagccacctaggctttggtattttgttatggcagcctgagctgactaatacactatgaatggtatcaataactcaaagttgatgttaattgtttgaccataagatgctgtaattccctttactacagaaacaatgaaatttaaaatgtcatattttgttacaaggagatcactactgtttataaaggaaaaatgaaaaaacatcaaataatcaaatacaccaagatctatgcagttgtccaacgctaagattacaactaccttacagaaaatgcacatttagatttttttaatgtctaagtatgtacctaaaattgttccttattcaacccactgttttgagtttatgattaatgatagctgcatgccatccatagaagaggatacaccacactcaatgccctgttaacagtcttccctttagctcagaatgatgtataataaactaatggagggagaaaatacctcaagatttaattggggaagggaaagtgtgaacagtttattcatcaccaggaaggcatccagaagcataattgctagattcaaaaagtagacagcccttgtggttcaactggacactgtgtgcttccaggaataaataggtgtgatagcacatgatagcacacacagagagcaccactgtttccctgcaaggaagacttaccctacttggactttaaattcctccaactgtaaaataggaggaaaacgggaagatgcctatagataatctccaaagacttttcagaattagcatgctaaggctccctaatacctgatgactgttaagcagttctttttcagactcaaattgtaacccattcctgaatcaggacgcccacttgctaaggcacagtctgcattttttaatgaagtaaaatacaaaataatagaaactatagaccatatcacacataatagggtaagtgttgcttaaccaaactttagttacacatcatatataacatgaacatgtatactggatcatgatgtaaaatgtatttcttgctgtgaatggcagtcacgagcttgaatgccaccacccttaaggatgtcagaattgccaactgtacatcattaaagacaccctcctacatacaattagaaaaaaagaaacagtgcagtcaaataaatatataattaataccatcagatagcttagctgtgcagcatttgtgttgaaattttagctggacaggtggtcagggatagtcacggtagtcatggagagtggcaactgtccaatcaccacgaagaacacagagatgtagagatgataaaactcaaagctcccctcatgataagagaatgagaacagaatacgaacagtgcagcagaactgaattaatggcaagcctgacttatttaaaatagctatctaccagcaagtggaatgaacacaattttggacagtggcctatttctggcttcaaacaatcttgatatttattatactttgacttaacaaagttgaaccagaaacaaaagaaagcagttgtcttagaaagggtggtgcctcccagagtgggaacaaacaggatgagagtccagcgcctgaagagtgagggcaacaaaaccaaccggttataccatggacaaggaggctcaaacaccctcacaagcacaccctttcacctccaaaacaatgaacaaacaaattacggaaagggtaggatcatcaagtgctactcagaaaactattcaggatgattgtacggaatgctatctgccttaataaaactccatgtgctttcgccagctccttcacatttatgacagctttacttcttttcatgcttgtatctatgacactgctgttctcaagcatgctgccctgatgtttgctgtggccttttaaggtttcagatgtcctcgtgttcagcgcgttgacatttttcataaagactctaagtttgaagttaagctcctattcactggtctcttgccacattagggtgacctcaaatgggccttgtatgtgtgaaacaccaaagtaaggtagcattataggtaggggctaggtatatattacaaaagagaccgcaaagtatgctcaaaaccgtttcagcaaatagttatgtgcattttggcttccgcttctgctcttccttcttcctcaccagtttttatgagtcagaagtttttctgcctctttcctaaacatgtccttatgggaaagtggggggctggttcagagagaggatgaaggaagctcaaggaattagggcaagttccttccttagcattttacacaattgagatctggttataataaatgctgaatctgaaagcttcaatactgacaaagattctctccttgactaaactgcagtcaggctcctctgagcccaggcctcgaccctagcatccatccttacaggacctgcatcacctggtgttagcaagaaaccttctaactcagtttaaagagagttccctcaccctccatgtctgaccaccctggtcctgccttcagcaagaatcctgttaggtctgtttaaccaaaatcccccctacccttaatgtttcctcttagtaattttccattcactgaccccctccccactcctacccctgctcctccttggctgtaaatccctacttgtccatgttgtatttggagttgagccaagttccatactgaggtctcttttccccttgtgatcattaattttgtgtcaatttgactggccactggcttcccaaattaaacattatttctagggcgttaaacattacttctgaggtgtctgcagggtggttccagatgagattagcatttgaatcggtggactccgttaagtagattgccctccccagtgtgagtccaacccattgaaggtctgaacagaacaaaaggcagaggaaggaatttgtcccttttttccttcctcactgcttgaactgggtcatttgatttcagtttcttcaaccctccctctagagtttacaccactggctcctctggttctcgggctttcagacacaggctaaattaaagcattggctttcccaatctgtagcctgcagacagcagatcctgggacttctcagcctccacaatcacatgagccaattcctcataatctctcatatatatatacatatatatatatatatatatatgtatatatatatgtatatatatatgtatatatgtatgagtatatatatatgagaatatatatatgagtatatatatgagaatattatatatgagtatatatatgagaatatatatatgagtatatatatatgagaatgtatatatgagtatatatatatgagaatatatatatgagtatatatatatgagaatatatatatgagtatatatatatgagaatatatatatgagaatatatatatatgagaatatatatatgagagtatatatacatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagagtatatatatatgagaatatatatatgagaaaaaatatatatatatatatcctgttggttttgtttctctggagaactctaacatacccctattgcaatgtttcctgaatgaaatctgtttttaccacttcgactgctgttaggcactggttttttaacaatatcaagtatagtagccatgtagttatactacagattgcattaactccttcctttattctacaaatatttatcaaaccataaaagtctaggtataatattgatgggagaagtagaaagtggggaaagctggaggatgacaaccaggaaggaaatagtacaaagataaataagtaaaactgccttccatcagcaaacttaaatcactgtggcagaaataaattagatacatgaaggtctataaaaccagagaggaaattataaattcacaaaaaacataataataaagaactatgagagttcacatgagggagaaatgatatgcagaggaaatagtcaaaaacaacattgacgatagaatgctgggagagtagaaagaggatgctgctactgctgttgatagatgcaggaggcagataaaagggagggtcctcggagaatctctacctgcctgagcagtgggagaataggatggagccatgggaatttcccgtgcgtgcaaggggcaggagcctgccctcttcagttcctgtgtttgtgacctggaaccaatctgtgagatgggggcctgttagcaggaactccgctagctttgctgagaggtcgtttttttcttttttccttttcgcccaataaattccattctcctcacccttcaatgtgtctatgtgcctaattttttctggtcgtgtgacaagaacccagtataagctgaactaaggaacaaagttctgcaacactgtgattagggaacctaggaagagaagcccatttggcaggatggtggcaactttggttttagacatttcaagttgcaatgctcctgggaccccaaatgcaaatgattggtgagctttccctgagaaaggtagagaccagagacaaggatgtggcttcttctgcaatgaggtcatagctgagtgggagtagtggagctgatcaggagaatcagcatatagaaagaagaacaaaggcttgagaatgcatacacgatttgtgcaaaagcacgaaaaagagccagtatataagcccgagtgaattaagctcaaaacataagaaacaatccagaccagtcaaatttggtagatgtctgtggtttttgccttcctggaatgatgaaagacatgtaacccttgggtttttgtcccatcatctagtaacagacctccttactgccatgggaactgccttccatgtgattttggtaagcataggagcagtctggatcctataatcacctgtgctactgaaaaactctttctccactagtcctgctgtgagtctggggacatcttaaaccatttctgccgccatgtgaaagaaggctaactaagaagtggagaaagacagattttcaataccatcacaataccctggataagctgtacctaaagctgatgtgcaccctgactcttaagttatgtgggccaatgaattccctttcggcttaagctaattaaagttgattttttttcactcttacaaataaaagagtactgatggatacataaagtaattatttaaaagtcacttttaaaagctagtgaatgaatgctacatcataacctataggaaaacaaaaagataagcctttccactctttaaagcttccacacttcttcctgttctccacacacaggctgttttgtctgcttggttgtcttatcaagtggcacccattaaataatacaatacagtaagaccatctgatcctgtaccattataccaaggccttcacatcacaccagaaatgaaatatcatcccattcaaaagccaccccagaaatggtttcagattttgttttgcaatagattgagattctgtgggaggctgagtagctcacattcccaataaggaaagtgctaggtgtggttgtattctctctgtggaggtaaaggcagggagacacagatttttgtaatgcatttagactcaatgacaatcaactttaaataccattacaaagccccagagggagcaagcagcagaactggggttagaatccaagtctgaaagagctctgtctagcttcttttattttagtcacctctaccctgcgctgccctgccagtgattgctacagctgttgctattcagtaagaactacagctactttctgaaatttgccatgtatgcagctgtgatgaaagccatgaaacccatccttcccccaccccaagtaagtggcgatctcctgttctttaaagagatgcaacaagtaagaggtttaataagaatccacctataatcttcatctgttctgctcttatagaagcccattccacttctccttcattctcattcatttattcattaactgaacaggttgctcacaccttctctgagtcaggtattccagtaggtgttgagaataagacatggttttcatcttcaacaatctcatcattcagcatagaaaggagatacatataaaacagataagcaaataaaaatatgcacaacatatcatgtgattaaaggaatgaggtcagggaaggcttcctagaggaggagatacatgtgctaagtttgttattttgatgcatctgattcttggggaaataagacatgatacacaaaaaaattaatggagagatcagtaacgcaaatgagtatgcaattagttggtgaataaattttataagcaatagttatcataagagttctgggaagcatataaggactacagtaatagcaaaccataatatatgcttaacacgtataacctctttaatcaaccacttaaatagattttaggttaaatttggatgaagaaatcctgtctagaaaggtaaatttctaacggtacaagattaaacaatgtaaaagtgttaaagacagaattcagatatatgtgttctcatgccttttgacttgtaagccagtattctggctgctatgtcttggtccaacactgagaaggattcaatgaaagaatcattgagaccctggcagagaatgcactttgttgcccctaatagtgagttgaaacacacaattaaattaactgttaaaccatatttaggatcccactcagagacagacttcaaaaataaccctacaataagaaattacttaatggacacaatatgtattattcaggtgatggctacactaaaagcccagatttcaccactacccaatatattcatgtaacaaaactgcccttgtacttacatttatacaaataaaaaagtccggccagctgcagtggctcacacctgtaatcccagcactttgggaggccgaggcgggcagatcatgaggtcaagagatcaagaccatcctggccaacatggtgaaaccccgtctatactaaaaatataaaaattacctgagcgtgttggtgcatgcctgtaatcccagctactcggaaggctgaggcaggagaatcgcttgaacccagaaggcggaggctgcagtgagccgagatagtgccactacactccagcctggtgacaaaccaagactccggctcaagaaagaaaaaaaaaaatcctacagttcaaacatcagccaacttttctcaccagagtgagaattttaggtatacttcgctttctgcacttcatttcttttgctttttcataattttgtttagtttgcagctatgaacttaaaccatttttgcagttggctccaaaaatgctgtgaagacaagtgagagattcattcatttatttactcattcatacattcaacacatatttaccgagcactactgcatgccaggtacatagcaatattagtaatcatcttaataaatactaaagtagatatgaattccaggattccagaggtttctttcccattaaataatcattgggatacctaaaagtgttttgaatatggcaactggccaaagatcccaagagagcaattgaaatacatacatttaaaatggtagtttgaatttaacaattgggagaccacttctgacccttgaaacaagtgaaccgtcccattaatttatccttttagggctcactgaacaatggaattggtgacttacatgttccacactcacagcaggaacattcaaagcacgagtgactgaggaaattgcttccagatttgttcttcctgcaataatgaaactgcctcaattacaaggcactcaagtttcacttccaaatctccctgatatatacatacatacttatatatacatatatatatgtatacatatatacacacgctgaatctctctctccaccttctcttgaagttttcccctctttaaagtcctcttcaaagtttactcattattattctatcaagataaaagacagttttctaaggtttaagccaagaacactctataaaaataatctctaggtttaagaggtggccagtcaagtgaccccaactctgtttccccaagattaatttttccatttttcctcaggttttcttacacttcttactgaagtcactctggcactgatgccaccaacacacatgcactctcacatacatgcacactcacactcatatacacacacactcacatgcatacacatacatacacacacacttacgttcactctcaaaactctttttgaagggaagatgaagaacgcttttcctgaatatacaatttaaaggataaagatgccttgttttatgatgcactgctagggataaaaagattattatgaaacaatatatagagaatgctgctataaataaggataaatctgtgctccaaatgttaacagtgtttatctctgagtggtaaaattatgtgtggttttattttttttcctttctgcttctttatatctgccaaagtttttaacaatgtacttgtatttcagtttcttttaagaaaaataaaattaagtcatgttttgtttgtttaaaatctctttttccaggttcccctaaacaaaaggcaggctggaattcttagagattttactaaagaaaaagaaagaatgttgaaagctacaacaatctttttaaaagaggtttacaacattttctgtctttgtcatagtgatggacaagtttcccagccctaccccattccatattcagcttttcgaggtcttgtcttgaaaagagaaggtgttcttttagactcctaaaagtgtggtgtggtgtcagagcacagacacccaatctagatccttcgcttcccacccctgacatgtcttcagggggcagaggccaccctacttcccatcatctgctagggaatcccatgggcattatcccattttgccaagatcaaaagcctttgtttccttgatgtacaccaagggtttcccactcagtccttctgaggataaagtgtggagggcatgctgcttcttcaactcagggctggggagttgccacaagaaatgagtgcaccttggccgggtgcggtggctcacgcctgtaatcccagcactttgggaggccgaggcgggcagatcacaaggtcaggagatcgagaccatcctggctaacacggtgaaaccccgtctctactaaaactacaaaaaattagccaggcctcgtggcgggcgcctgtagtcccagctactcgggaggctgaggtctgagaatggggtgcacccaggaggcagagcttgcagtgagccgagatcgcgccactgcattccagcctgggcgacagagcaagactccgtctcaaaaaaataaaaaataaaattagcatggaatgggtttattgttatgtttaataaattaaatattttcaagttttcttaacattaatttctataatggtaagtattaatagatataaatcacatatattaaggctctttggtattctcaataatttttaagagtacaagggggtcctgagaccaaaatgtttgagaatctagcagataaaaatgacacaccagcagagagagcccttatgtaccacttcactgaggagctaggagcttctaacctaatcgtatccaatacccttctcatcctggttatcctacaactccacaaggttgtttctactgatgcatcacccatcagcatgtccttcttctgcccaaactgcaacccttgcacacacacataccaaaaaaacaaaaacaaaaaccttcaaaattacacatttctggcctggcatggtggctcacacttgtaatcctagcactttgagacaccaaggcaggaggatcacttaagcccaggagttcaaaaccagcttgaatgacaaaaataattaaaaattagctaagcatgatggtgcacaccagtagtcccagttactcagaaggatgagcaggaggatcgcttgagcccaggaggtcaaggctgcagtgagtcatgatcgtgccactgcaatccagcctgggtgacacagtgagaccctgtctcaaaaaaattgtacacatttatgccgagagtctaaagtcctaacacttaagaacctcacttgcctgtctctaatattccttcccccttcagcatgctgtaaaaggatagatgaatactctatcctaaccagttataatcagccttatattgtaacttcactgtgactttgcatctcccatgacccctgcctagaatatgatacatctcctctcaaactacccaactcctgtctgtcctgcaaggcccatttggaatccatcttcactgcctaatattgctatacccatcccttctccagactccagacatccctgttatctatttgtttagcacttaatgtgtgcttccatgtattattatcttctcatgaaatggatattccttcaataagatcataaaaatctacagagaatggacttcttcctttttatatcttcttcaacccctaataagtccttggacacataagacactcaatttataaacaattgctaattttgtagattaaggaaagaaggtgaatgaaaggagatttcaaactagcacactgtgtttgaatataattctgagaaatataaatcaataacctgggaatcatctaccaagacctctgaggaggcaaatattccagccataagtttttcttctcattctatgaaactttcctagaatcagtttaatgtggccctgatgctacaaataaactaatcctgatatcagtgtttctaagttgccgtaaagaatatagtaatgggctacagagaaaatcccaggctaaatgagaagaaaaaaattcctggaaagttcataaactaaaagtaataaaaactttatttccttctatttagatggcccatgggttaaattttaatgtactattcttttaggttttttatgtgtgtaattggacccatggaaatgcatgaatacctattccatttcctcacctctcagtcattcctcaacccattgtggtctggcttctattcccaccacttccttgaaattattctatacaaggtcactggaacctccctattgctaaatacaatgggtgcttctcaggccttatctctctgtttttttttttttaattcattgtcggcaacaaaaaatggaattgctggtttaccttaaattaaattaaatgatgcatctaggttgatgtctagatcatctgcttaaaccagcagaatagagagttcatgtgtccttttagaggatgatgaggagggaaaggaatattaatttagaaggttatgttggtttaaaattaatcatttaaaaatttatcagttaaaaaggttgaagttatttatcaagtatttcattcattcaacaaatatttcttgaatatcgcctaaatgtcagacattatgctagttatgggcatagcggaggctttccaggtaaacccagtcctttgcctcatggaccatacagactattgcagagtccatattaaggcatatataactgcaggggccgggcacggtggctcacgcctgtaatcccagcactttgggagaccaaggtgggaggatcacgaggtcaggagatcgagaccatcctggttaacacggtgaaaccccgtctctactaaaaaaatacaaaaaaattagctgggcttggtggtgggcgcctgtagtcccagctactcgggaggctgaggcaggagaatggtgtgaacccgggaggcggagcttgcagtgagccaagactgcaccactgcactccagcttgggtgacagagagagactgaatctcaaaaaaaaaaaaaaaagacatatataactgtagcatagtctggtaagtgtggaggtaggctccatgaatttggagaagacagaggtattagccaactctgaagtaatgggactgtcaaagccttcctggagaaagcagcactgaaggtgaaatgtgaaggaaaaagtagaaataaggctggagaaatatgggagtgggggcagatgcttctgccgtaaataccaggcaaatagtttagagtttattttcacaataatgggaagtcatgtgaggatagtgacatgctcagatttgcatattaaagattcaagttggctgggcacagtggctcatgcctgtattctcagcactttgggaggccacggcaggcggatcacctgatgtcaagagttcaagaccagcctgaccaatatggtgaaaccctgtctctactaaaaatacaaaaattagctgggcatggtggtgggcgcctgtagtcccagctatttcggaagctgagacaggagaattgcttgaacctggaagatggaggttgcagtgagctgagatagtgccactgcaatccagcctgggggagagagcaagaatctgtctcaaaaaaaaaaaaaaaaaaagattcaagtctgtgaactcagctctggaccaagctgagttaatagacatttacagaactctccaccccaaatcaacagaatatacattcttctcagcaccacatcgcacttattctaaaattgaccacataattggaagtaaaacactcctcagtaaatgcaaaagaatggtaatcataacaaactgtctctcccagctcagtgcaatcaaattagaactcaggattaagatactcactcaaaaccacacaactacatggaaactgaacaacctgctcctgactgattactgggtaataacgaaattaacgcagaaataagtaatttctttaagaacaaagacacaacataccagaatctctgggacacagctaaagcagtgtttagaaggaaatttatagcattaagtatccacaggagaaagcgaaaaagatctaaaatcaacaccataacatcacaattaaaagaactagagaagcaagagcaaacaaattcaaaagctggcagaagacaagaaataactaagatcagagcagaactgaaggagacagaggcacaaaaaaacccttcaaaaaatctctgaatccaggagctggtttttttgaaaagattaacaaaatagatagattgttagctagacaaataaagaagaaaagagagaagaatcaaaaggacatattaaaaatgataaaggggaaattaccacttatcccacagaaattcaaactaccatcagagaatactataaacacctcaacgcaaataaacttgaaaataaagaagaaataggtaaattcctggacacatacaccctcccaggactaaaccaggaagaagtttaatccctgaatagaccaataacaagttctgaaatggaggcagtaattaatagcctaccaatcaaaaaaagtccaggactggatggattcacagctctgtatcggtattcacggatacagaggagctggtaccattccttctgatactatcccaaacagtagaaaaagagagactcttccctaactcattttacgaggtcagcatcatcctgataccaaaacctggcaaagacataacagaaaaagaaaatttcaggtcaatatccctgatgaacatggatgcaaaactcctcaataaaatactggcaaaccaattccagcagcacatcaaaaagcttatccattatgatcaagtcagtttcatccctggaatgcagtgctggttcaacatatgcaaatcaataaacgtaatccatcacataaacagaaccaatgacaaaaaccacatgattatctcaatagatgcagaaaaggcttttgataagattcaacaccacttcatgctaaaaacgctcaataaactacgtattgatgggatgtatctcaaaataataagagctgcttatgacaagcccacagccaatatcatactgaatgggcaaaagctggaagcagtccctttgaaaaccagcacaagacaaggatgccctctattaccactcctattcaacatagtactggaagttctggccagggcaatcaggcaagagaaagaaatgaagggtattcaaacaggaaaagaagcagtcaaattgtctcgtttgcagatgacatgattgtatatttagaaaaccccatcgtctcagcccaaaatctccttaggctgataagcaactcagcagtctcaggatacagaattgatgtgctaaaatcacaagcattcctatacaccaataacagatgagagccaaatcgtgagtgaactcccattcacaattgctacaaagagaataaaatacctaggaatacagcttaaaagggatgtgaaggacctcttctaggagaactacaaaccactgctcaacaaaataagagaggacacaaacaaatgaaaaacattccatgttcatggataggaagaatcaatatcatgaaaacggccatactgcccaacgtaatttatagattcaatgctatccccatcaagctgccatttactttcttcacagaattggaaaaaactactttaaatttcatatggaaccaaacaagagcccataaagccaagacaaacctaaggaaaaagaacaaagctggaggcatcacgctacctgacttcaaactatagtacaaggctacagtaacaaaaacagcatagtactggtaccacaacagatatatagaccaatggaacagaacagaggcctcagaaataacgccagacatctacaaccatctgatctttgacaaacctcacaaaaacaagcaatggggaaagaatttcctatttaataaatggtgttgggaaaactgactagccctatgtagaaaactgaaactggatcccttccttacaccttatacaaaaattaactgaaaataaattgaagatttgaacataagacctaaaaccataaaaaccctagaagaaaacctaggcaataccattcaggacatagacatgggcaaagacttcatgactaaaacaccaaaagcaatggcaacaaaagccaaaattgacaaatgggatctaattaaactaaagagcttctgcacagcaaaagaagctatcatcaaagtgaacaggcaacctacagaatgggtgaaaatttcgtaatctatccatctgacaaagggctaatatccagaatctataaggaactgaaacaaatttacaagaacaaaaacaaacaaccccaccaaaaactgggcaaaggataagaacacttttcaaaagaagacatttatttggccaagaaacatatgaaaaaaagctcatcatccactgattgttagagaaatgcaaatcaaaaccacactgatataccatctcatgccagttagaatggcgatcagtaaaaggtcagggaacaacagatgctggagaggatgtggagaaatgggaaagcttttacactgttggtgggagtataaattagttcaaccattgggaaagacagtgtggcaattcctcaaggatctagaaccagaaataccaattgatggtttgcagtcccattactgggtatatacccaaaggattataaatcactctactttaaagacacatgaacacatatgtttattgcagcactttcacagtagcaaagacttggaaccaacccaaatgcccatcaatgatggattgtataaagaaaatgtggcacatatacaccatggaataccatgcagccataaaaaaaggatgagttcatgtcatttttagagacatggatgaagctggaaaccatcatcctcagcaaactaacacagcaacagaaaaccaaacaccgcatgttctcactcataagtgggaattgaacaatgagaacacatggacacagggaggggaacatcacacactggggtctgtcaggggctgcggggctaggggaggtatagcattaggagaaatacctaatgtagataatggctgatgggtgcagtaaaccaccatgtcacgcgtatacctaagtaacaaacctgcatgttctgcacatgtatcccagaacttgaagtctaataaaataataaaatgtgtatatatatacatatatatgtattcaagactggaagaaatgtagaggaaagagatatgtgaggcaagactggatgcagagggcggcagcagtaacagagtgtatgtgtattgaatacttacagcatgccaggcaaaagacagagtggctagacatattatctgatttcatctctactacaatcccataaggtaggtacaattttccccattacacaaagaggatgttggagcttcaagagattaactaagagatatttataagttattatgacaagacttatgtgcatttgatatgggaaggggaaagaaaaagtgaggagtcaatattaacatccagtttcacagcttagttcagtgagcagatagtaatacctatcactaagatgggcaaaacaggaataccaaaaggttttgatggagaaagagatggagttgatgagttttgtttgagacaggtttagacctgttgagttggggaaaagaaaagagttagacatcaattgtcagctgggtgcgcaaggctgaatctcaagagagaaatctgaagtaagccaactcatgtagaaagcatctacagatagataatcacagccatatgagtccttgaagatatacagaaagagtgtgtgacatcaaaataaaacaggctcgagatggaaacctgaggagcactaatatttaaagaatgagcaaaggaaatcaaaattgaaaagcagcagccagagaagtaagaaaaacatggcacaaacagctgcaagcaaggaaagaatgtgtttcaggtaggatgtaatcaacaccaacaaaattatcagagcggtgaggcctgagaagcacccactgaacctaacaataaggtggttccatgtgacttggtataaatttcagggaagtggtggggacagaaaaaagccagaaccaatggtttgaatagtgactgagaggtgagaaaacagaacaggcattcgcacctttctatggtccagttatacacagtaaatgaaacacaaagatcatggaatattcaggttagtcagagcaccgtggccttgctaatacagcatctgattaaagttagcccaaggaaaaagaactgaggattcaaaattggaatgtctggtctcccagaaaaatctggggactttgtctaacttttaccaaatgacttattcgtatctcagtttctgggggaactgatatgtcccaattttctcacaatattgtttcgagtatcaaatgttaattgtcaggaaataactttgcaaggttaaaaactagtttgtagaggaagtaataatgagttttagggccggccctgattattgcaagtacaactttaacaaggggaagaaaagacattttttccctcttttcactcaaacaagaggggaacatcagcagagaacatatgccagcttcaaataaatgattgtacagttcccagtggcttcaagaaaatggcattagttctaccttgacattcaggcacttggatgacacaagaggcacttggctttttggaaaataagtccttctgtgggatgatactcttcagcatgagaggcaatagtggaaagtgcatcggttatagaatccagtcaccctggaatggaatatgtgctctgccaatatgagtcatctgatttaaagtgagttacttaacctacctaaggttgagtttcctcaagggaataacaagagtgtttactccatgggatcaggaggtttaacagaatggtgtataaagaagaactgagcaggatgcctggaacacaagaagtgctccgtaattgttagtaaatattcttactaggacaggacctgtttcctctgccacagtaaaggccctacccacaacatttacttaaacagcgttcatcccaagactagagacagagccagtgtctagctgttcatgctaatgtgtaggtgaagtaaccgaataatatacttacgttctggggaactctgctcctgaagaaaactgtagagcattatgatttaacattcaaactctattacctggtaccatcatagcatgcatctcttaacataagggactgcatgttttatagaacatatgatgaatatttatataaagcaggaacttttgccaagctcagaatcggtgtactgattttactgttcgctgaagttcgggctaactttctgtttccctgtcgctgaagagatacatctctcacttcttccagttagactaaaataatgctcattctcttatctgttttctatccaacagggttcagctaaatgcagagggtcctggattcttcggcttgcaaaacccatatagaggtccatacagatttagaagtagatctcaatttaaaaccgcaattctatccatttctggaagtattatatggttccccaaacattcacatttcagtggtgatgccaatctggggcaaaaataataaaataaagccaacttctaaatgtagcatcagaagtcctctggaagggaggtaataatttcaatgcacattgaagtactcaaattattttattagtctctactcctaaggtttacattttcaagaatttactaccagtgtttggagaaagggaagtggaggtaaactgtaaaagcctctctgaaggtgagtcaccatggaaaccaagactgaaatcaaaggcactggactgacttatttctcactgatcttttttttcattaattcttgctgtcttttcatggctgtgctttcttcttttagttgacagacgcttgggtgttcagatcatcaatggaagacaattttgttaaggataatgtagctatatcgagtaacatactattatgatgataataactatgcattgagcacataatttgagccaggcccaatgctaagtattttacatacattgtcttttgtattacgtattattggaagcaatataggtaatggaaaaaagtcttatatctttattgagttggcacgtataacatactgaatatataagtgcccgaaatatgttaaatgctcaataaatgttaatattgttcttattttctagtccaaaaaactgtcctatgagtaaggctctttttttctcaatttacggatgtgaaaactaaggattacaaaaagagggtaagtcacttggctgtgatttcccaggtggtaaacaagagaattagaatttcagcgcaagcttgcctgactccagaagccagattgtaaaccattatgctgtattctctaagatagttagaggtctaagaagctcaccaaataaattggttacaattatggtttattttttaattaggttcaaagaactaaagacttagaggcattatcaatgctcacttgatttttttctctagctattcaattagttatttaaagaaaaaaagtcaaggtgttaaatatttggccttggagggcataatgctacatttcaggttcacctttaatctagactcaacagatttttgtttttattctccttaaacttcaggccaggaaaaacaacagagtatctttagaaagagacggaagccaaattaaacaaggctccattctgaatgttttctatgctcccaaatcctatcaacacaaaggtaattcgatgaaaggttcatttctttataaaataaatctcaaggctactgaaacagacaattgggaataatttgagaataaattaattagttttgattacaaacaggaatctactgttatataaagttggaaatgggaaaattctgaaaattacctagttttttagatagcctagagtttagtaacattctttttttaaaataaattgcattgtaaatgaccctaatactagctgtttgcacttagtaatgtgtacatcccttgaggaaacaccacttggaatacaagtaacttgcaaacccattaccagccacattaaattgccttcattagatgttgcttttcttttcctgaggatcactgatccttctcaacttcaggccttattttccatttctatttatattcctatttttctcccccaatccctactaccaccaaaaggaattcacttttctcaaaaaaaaaaaaaaagaatcaaaagtatattaaatttaaagaaaacacctttaaacaattattatggttgaaaagtaataggtttttatgactagaaagcagaaaactaagtccctgcccctcaatatatcccaagataagaataaatcatggaaagcataacagctgcaaatctcccacccagatgagagaacaaccctagggaacatccctagagagaaagatctatcccaattatggaaagttcacctgataactgtgtgagaaagctcaaactgcctcctagcagcactgtcttacctatagttaagagtcagtgattctgttgaagtacttggctcggctcacctactcttccctccttgcttcaactcattccccaacacctatgcacaaaccactttctccagtgttgtgcagttaagaatgcaattgcttcagaggcatcataagggaagatttccattctaaaccgccagaagagacagtggattcattggccgaaaacttctagcataaaagtgagaaatgaactgaaaggtttcatactagacatgcctgaagtctatccatagaagaaagtactattgttgctcaaaatatagtcccttaaaaaaattcattatatatgaaacaataaaagaaaatttcatcctctaaaaaagaattcatgtaattcacatgaaaattcatcacatttggtataagcaagagttcaatcaataaattttttaaaaaccaaaccagataagccaaattgactgagttataacttttccatgaggcatttccaaccccaaaaaatccctcacctttctaaactagtagcagatgttttctagtatccatgtgacaatcatatatggccttgtgatatgttttacaatgtctgctttcgtgattactgcagctttgccttccatagtcacttttcacagtttccatcttatttctttttttttttttttttcgagacggagtcttactttgtcacccaggctggagtgcagtggcgccatctcggctcactgcaagctctgcctcccgggttcacgccattctcctgcctcagcctcctgagtagctgggactacaggcacccaccactactcccggctaattttttgtatttttagtagagatggggtttcaccatgttaaccaggatggtctcgatctcctgaccttgtgatctgcccccctcagcctcccaaagtgctgggattacaggcgttagccaccgcgcccagcctccatcttatttcttaattataaggtctctgaggacaaagacaagtcatcatcatcgtagcctccacagctctagtaccatttccttaatgtgactaagcaatgtaaccagataggcagtcgatgactagtaacttctccctgtagttcaaaatctaaggtcatggttgctctagctagagaaagtatggttttctagattgtaattcaaaaaatgcactatagcatagtgtgtaagactgcctgaggttctaccacttacttcgtgacgttggtccagttacttaacctctctgtgccacatttttcttacacataaaatgaagataataatgggacctttatcatagagttggtatgagtatgaaacatgataatacaaataaattggttaagggagtaatgccacacagtaaaagattaataaatcctagctataattattacattacatataaaagggttcatatgactcctagaatagtgggtaaagatgtgattttgggagttagatatgaaaggaatgaaaagcattttcctaatggatcccaatcacacctggcatcaaggcaaactaagctcttgacatcacagtcaaatgaattacgaatgtccctcattttcccaaagccttgaaatacaatcaacacactgtacacaatcaacttatgtgagagtgatctaatagatcagaatggggccattgtcttggaggattcttaacaagagacctaggtaacctcaccctctgtcctgcccttccagtttctcacctgaacaagcaggttagaaggcattcctagaaggtttacccccaccatttctcagcacataaaggggaaaaaaaaaaaagaacaaatgttctttatctcttctgtccatagtcagtgcttcccagaaacaccctcatctaacccatcattacccccaccccaggaaaaagtgcagtagatgacaacaggcaatgcaaaaaacatgtttgcagtatccacacacatacatacactcctttttgctacataccactagcctggccatccattaatatgagcccggagttattctttctccttctggcatcacagggtcagaagataatgaaggaagagatctagcaatacttaaataaataatgattacaggcaaaatattgaaatagaaaaggcttatctttggggccttttgcatactcttcagccatgcctgctcttcttgaagtctctgaaggcagagcctttatattaccttctgagtttctccaaattcaagtggtccttacatctcatgaaatccactgcagatggctccttagctcccaccttgacccactccaatacattccacactctcatgtcagattaatgttctgaaaacacaggtcttatctcacattggtttttaaacacatttattcctagtgttccattattgaaacactaagcatgtgggagttatttatatcccactgctcaaggtcattgccaaggtctgattgcaaaaattcaaaaaattgcaacctcaggcataaatgggttagttccttaatcaggcatatcactgtttcgtgcattataattatatgtgcatatgtcatgtctcctccaatagactgtaaagtcatgtgaggactcaaattatcaaactcatcttaaaccatcttcacccatctattcaaaaaaattataatgaatacatgttataaaccaggcactacactagtctctagagagaggagtcagaccatgcccttcaacttgttaaaaatcttttggagggtagagagaggcagcaggggttatagccacataagcagaaaactgtaatacatataaaataatttacatgttataatataattgcaatatataatatgttataattgcacaagcaccaagaaatacaggattgcattgaagggacttcgactacactcttgagaagatcaagaaaggcttctcagaagaagtaatgtctaaactgataccagagcataatcaggtatttctagagaaccaggcagtgtaaatggtccattaagattggaactgtgacaaaggatacggtttaagaaacatacagggaccaaatcagaaaaggactttgaagccactctaagtgtttgtagtttatctaaaagtcactgaattgtttaacaggatgaatgatatgatcagatttgtatttttaaataaccattcaaattagagtgcagcagtcatttaaaatgtctgctgaacacaggaatagaagtgacatcagcatggtaaaaaatatttcaggaattcagaaaatagagaaatcagtaaatcagtgctggctgtgataccccagaaaggttttatggtgaagtttaactgggcttaagagagtagattttcacagggcaattcaaggaaaagaagaacatttcagtcaaaggcaggaaaggtccaaggaagataatgagttaagaagtggttgagcaaaagcttatgggaatccatagagcagtgagtagtttagtttagtgggtgctaggtctggagaggtaggttgacacaggaggatcaggccttaaatgctaggctcaagatttagagtttgccagctgagacagttcatggaggctttttgaaagagtgttgctttgagaagactgaatatgaactgaaaaaggttaaaaacagaacttggttaccagtagaaatgtgagaagaaaaaaactatgtgcactacaggagatgggctgcaagatatatatcaaaaaatatatatcagaagaagaaattctgaatggaggcatttccagcagctcagtgtgataatttagaaaataggatcttccttttatcaggctgtttaaccactatctacacataagaacttgaaaatacagtgtttgaaagaggaaatgaggaaaaggaacatttgaagaatgagaaaggaacagctgaacaaacaaaaggcagcactgaggccattcttaaatgtcctagattaataacccaggggtatccagatatttggggcttccctgtgtattctaggaactcccctcaatagatcagacctttatccagaaatgagggccccagagacctatttggctaaaagggctccctcttctttgttgttttggtcactgcttctacctaactcttcgcactgtcagtagctataagaagcaaaactattggctcaattgttctactgtctacagtttgaactctgacctctttgatatcccaaagcaacaagctaatttagtagtccttacttaaggatacgaagaaaaatatttagaaaaccttccaaaattgtctaacaaatctccagagttcattagtctattacctgagaaaagctgacctaataaatatcacagccctcaaccaaaagaacaatgttatttgaaaactaaatcttgtagaagattcaataaattcctggaccttgaaacaaattttatcttcttagcctttttcaaagccaaaaaccagtgtctcacaatagacatgtgcattgtttattccaccctgtgaggaaactgaagttgtattcctcagggtatgtaagcattaatgaccctaaaattttactccagaattgggtggtttcacactggagcatacatgaatgttgtgggctcaagtccatcacttaccagcaaatcaatggattcttttagattggtatttcatttgtcatcatttaaccaatgattattgtcatcattaggactttttagaacatcaggcaaggtaccgtggctcatgcctgtaatcccagcactttgggagaccgaggccggcggatcacctgaggtcgggagtttgagaccagactgaccaacagggagaaacctcatctctactaaaaatacaaattagcccggtgtggtggcacacgcctgtaatcccagctacctggaaggctgaggcaggagaattgcttgaacccagagggggaggttgtggtgaactgagatcgtgccattgcactccagcctgagcaacaagagtaaaactcagtctcaaaaaaaaagcaagaacatcaaagagatgtttgttaggcttattaagtggtaaattttccttggcttccttttctttccaaggtaattatgggcttcttcctgtctctttttgatgcccacagaggccataatgagggcagttaaatatgcaaacatgagaatgagaaaacaggtgtcaagatacatataattttacctattgagacatcctgcctgctaataaacagagaatcgtattactggtacacttaaccaattttcctaaataatttaggcatgttttccaatgtctttgcaaaggtgatgtggggaggtcttttgcccctttaaaattcatcaacacctccagacactgcaagataaggaggtcatgcaagtcaaaacaatgtgtgggctacagatatgcagcttcaagtcaatcctctaaacttctttccaagcacgtgaccatacctacctggaaatactggagtcagctcagttgtttcccctatttgataagaaaagaatgcaactagccagcaaacactttattttcttaaatattagcataatttgtgggcatttccatttttccaacacatcatttctcagatattaccccagataaaataccatgcccagaactggaattatagacaatttactaaagaacatgcataaggggaccacaaaacccttctagatcaaagagagaccacctctgacatgccatggcatcagaaagttctacttttcttaagagccatatactttaattgtggtaagatatttctaacaaaaagatcaatctacgtataatgttattaacatggaatttatttgattacagtttccctaactgtaatctaaagtcatattcattaggaaacgccaaatttccaagagcagagtataatatgcagcatttcccaaacatcttggaccccaaaaacttcttgtaacaaactaacatcgtccaaaaatgacaaacgatatggaaaataccgtattctaccctccaatatcagctgtcagtgggacaggagtaaaggaaaacaagtcaaagcactgagttaactgagttttaaaagacggagagcagttttggaaggatgcagaaactacactttgtctacttaacaattttaagaactacccaatcacagagtatttattatagaaataattaggaataatttgattttatgtttacaaagaggtatgatgtttaactgctcctacgtagtttgaagcttgttcttaaacccaaggtattgccaaatgcctagtagtaccctgtttattactgaaaaaatttttttaatcattttggataaatactagaatcaaatatttgacctgacatatgacaaggaactaacaatataagcctagtctaccaccatctggatgaccaaattagaatcttagtctcaaggccgcccctgtttcagccctgaatgcctcatgtaatgtacacaggagccagaactacattatatctcgttttcaaatagcactggttacgcaccgggcaactgttaaccagggtggcatgtgataatcttccttgctaaccttgtaggaagtgtgcgagccgttatctttctggcaagatttaagtaactcattcctatctaaaaagcatctgttaaagtggcgtcacaccctcaactacttcataaagttttctataaaatgttaaaatcaccagagtcggacctctcagttcatcaggcgtaaaactgcagtttccggctgccaaatcccttaacaacgttaaccttttaatccttcagcctcgtctagtgaaaagcaagtgtcaccagataccgccttctacttgagaaatataacaagattctttctcctgcacttttcccaaataaaaacggctcatatacaaagtgaagtctagggacacccacagtacggagggctgcccggacctggcggccttacctggttgaagtgcagctggccaggctccgggacgcccacgcgggaggcggctcccatctgctccagcaagtgctggagctgcgccgccgacaggctcagattcgcgccgaacacgctcagcacatcctcgctgaaggctagccctggcccctccgccactcctccgaggccggcggccgccagcaacaggagcccggccaccgcgcgacccggggccatcctggcctgggcttccccttgagggcccgcgacgggctgccgcgcagagggacgcgcgcgggcgcactggcgtccttgcccaagggcgggagcgtcagtgctcggcgctgctccgagtcagaggtggcgcgggacgcccctggttctccgacgccttcgaaagaacagcagctcgcgacctgcggggcattgaagtggcagcgtagccgaggggagcgataggcggagtgggccccccggcctcctggagagcctgagataaagaggacaaagggggacagagataaaggccaccagggcaccagccggcaggctccagaaacgctgcgtggcagtagccctcaaacgcccggccgggcatggggccagacgccccggatccgggtttgcaaacgccccaggatttgcgtacatatgctcctcccggatataaagccccaaaccacgccacttcttaggaaaaactaaaaccacactaactgtagaactccacctcctcttcctgtctttctgctttattctctccgcc

SEQ ID NO: 2112 - DNA, 92605 bp, Homo sapiens
cggtgattcagaactactaaacatttattgaatgtgtaaggtattaaaaacatttacaattttgttaataaaatgatgttttatattaatgtatgtattatgctttggaatatgctaagtcatgtagataactttacatttctttcaataactttattctttacaaaatatacaaataaataaaacaattcaacttttaaaagtattaccatatgcaagaagaaggtattgctatcaccattctaaattaccacaatgcattcatttcctgttcccttatctttcaactctagtggcaaagtaaagactgaattgaaattaagctgcactacaacatcattaccagggatagacacataaacaaagtcatttccaaataaggaatgctggatctccagagaagtgacaaagaggagtctactgagttttgcactcaggcacatccttgcctgaggaggcgtgccaaggacctggctgagaatccacactctctgctcctgcattttgcacctctgagaaagaaaatgaaaacaacattcatcctattacaaaaatacacaaaaaccaagcacagctggaagtggaaaggaggttaagacaggagagatgtgaagaatgaaaaatggcaacgtgattcaccgtgtttggtcatgaagatggtgtatttcacctcagagttggagaagtttactccccattttgtcctaaaatgaactattagacaaaccatagttaaactgagaggtaataaagttttatttggaattcttcaatttgaaattcaaagtgaatcaaacacgggctgattgagttttcttttgtcctgtttttcaaaataaatggtgtgctaaacaaatagtattttagagaatatttaatcatctttggaaagctttctgtgagcctttaaaaaggactttagctgcatctatttgcttataaacaatatttattttacaattattatatttataaaagtaaatctaccataactggtcttggcaattaccttagtttaaggtaatttagattaccttttataattaaaagtaaaaactcacatttatttttttaaagactggtattaattcaagctgggactatctcatttaattctgaattggtcagtttttgatttatgtattcttctaggctactcttttatttatctaaaaacagtaccagagagatccacatattaaaaaaggactcaaacatttttatttgcagtttgatgaattcacattatgcatatgcctctggcactagcagacaaaatcaaaaggtgattacagctgggtgtggtagctagcatgcacctgtagtccttgatgcttaggaggattgcttgagcctaggagttcaaggccagtttgggcaacatagtgagagagttccatgcaagtgttagctagccaatagaaggtccttaaatgtttgttaaatactatttaatgaagagaatatttcaaacatgtttttattccaaatgtttctgtgcctacctatctccctaagaacacttttagactgtcaacttgatctaattttgatgtagttgatgagaatggatagattttttcttaatcacaaagtagaggtttataaactctggcaaatagtgctcaaggttttaaatgatttggcaactgcctttcttactgtacaattttgttgctttagatttctacagttgcataacagggtacctctggtagggtaggcagacacactgtcacaaagggctgtgcacagtagatgctatgtggtgagaaagactacaagaaatgccgtgttaccgtttctcctgcaagtccccccacttctgtggacaacctccatgcagagctgggggtgatccttgatacctccccactcctttgttcaatcaggtgcctggtgttgctgattttactccaaaatctctcccgtcggtctacttctctccttctctactccaagtccacactaccatcatgtcttgtttagacaacagtctaactcctgctcctattatttgctggtcaccttagagacgaggtgatgttttcaaaatgtataactcatgttctcctgccattgcttaagatctttcaaaggcttcctctacacaataaatgaaacaattcctttatataatttataaaagtccagcatttctggctcttatttctctctttggcctcactgacttcacccacacaagcttgtactcactgtgctctgaccacaccatatttctttcaactcttcccctggtcatgttcccacctaccctaacgctgttgctgttccatctgcctgagatgtttttccctctgctctttattaagataactcatgttaaccttttagatctgatctgtttccttcctcaatactcctcaaatacttattatatttctcatagtcttttgtacttgcactgctataatttcacttttttttttttttaatcacttgattactgtctgtatcttccatgagaattaagctctatgaaggcagggatcatgtctggttttgcttatcaatgtgccaccaggatctaatccttaacacatagtaggggctcaaaacaattttattgactgaataaatgaataagtaaatgattcatctattatctggcttgggtaaagtaaatataatgctattggatattttggtccattgaattgataagacttttcagtaaaagttgctttttagggtagtatcttcatgtccttgagaaagttgcttgtctctctttggacgaaactaaaggcttaaagggtagactaaagacttcacttggggtaaaagtgaattgcacttcactgtgtggggtgccttggagaaatcaactttcttacagagtcagcaaatgaagcctgtcattgtagcttactcaactaaatcatctcttatctaaacttgccctttgggatcacatattaatgataagttccaactgttaccctctgatttccaagtaaccagtatatttacttacctggacaaaggcctaaacttgagttatcaaaatagcgaactggatgaggtgatggtaaagactttgatcggctatcaaaaaaacaagattttggtgattcctttggcacaggatcttgtaaattccgttccttgcattgagagggtgtaatttgtttctttttagaagctgttccagtcactttaggagactttggagaattctcacaagttacttgtttgtgagcctctcttttaagggttctttccttccaagttttgacctcattggaaagatgctgattattgcttaaatgtgggggaagaaaagagagactgtaagacttcttgattcttaagatgtattcacatttatatttaaaaattaaaaataaattgtgatgaaatatatataacataaaatgtacattttatcacatttacattttaatttcaacctcatgcttcctgttttgactattttcaaagttcagaaaacaaaatggatctatataaattgaataatatagtaagtttccatgatcatggagtcttgaaaagaaagctctaagtacaacattaggttttcaaatgaatcaatgatataatccagagtggcttatctattgatgctttgccacaataatttgacaaattagtctcctggatagatgaatctttgatgtacctttcttactgtaaaataaatattacactgtgcttttctagttacaatgctgcttcttacaggagatgccaccagcatttatccagttcctccggagagaaacctgggaagcaatcctagagacctcactctcttttattttaagtcatccaagtctcttgatacactctcatcctatctatcaaattcacttccttgtttttatccctattggggccaagctagtccatgctaaaattactttttgtctgaactaccataaacacattctaaaatttgatccctctataatgctctagcagccaaagatgctatatgatctcatcaggccactagcttaaaaccctccagtgcaggtaatcctgccattacatttaggataccactccatattcttcaaaatgaactataagggcccatgtaatctgaatctagttacctctggcaccttgtcttgcactttactctgtctcattctctacattctggccacactggatgtctttcagtcccaccaattagttattcttcttaactcaaagcccgtgaacatgttcccctggcctggaaaacttatccttcttccctcatctagcctaattcctactcatttttcatatctattctgatataggcataccttggagatattgcaggtttgtttccagatcactgaaataaagtgaatcgcggaaatcttttgggttcccagtgtgtatagtagaaagataagtgcaataaaacgaggtatgcctgtttgttggcttcctgatcaaccaaccctccacccctaacacctagataacgttggatctctctctttcataatataacccttttataatgtcctttttgtttttgtttcttttttaatagcactcatggcagagttagttatttgtaaaattatttaacgcttttttttctactgtatcatagtagagtgcttggggaaaagattctactcttccacgtggtagaagccgaataatttgttagatctgtttataaagtaaaaagcctacaataatggacgtaaggagttcctctctaagtaaagcctcactggcttgggtatatggacttgtggtgtatttcagctgccccctcaaaggtctttgtttctttcctatttcttgccttggttaagaattggtcagttgatagacagcaaacattggaatagtgctaccatattctcattttttaaaaaagatacttattacctgagctctaaaaattactttccccataatgactgaagtgttaccacctgcaaaaaatacgtgcatataccatgtccctacatatatgtaatagccgtaagcataatatccgtatcatgtaagcagatcttaccttaacaattcattcttttgttttattagctgttcattttgctgctttaacttagaaatttctttttctagccttatatgttcacttttcaaaataagagcttttgtgttttgtacaatgccgctgccacctccacaagttaagggtttatttgaaggctgaggatcagtatgttctgatatcactgtgggaggaaaatatacaaataggtgataattttaattgtctccaaagttcaaaataaaggaaatactaccaagtacaataagccattatagagacccaaacagctcaagtcttatttccctggaagtcacccttgacttctgccttctaccttactccctctgcttatttgaccaaccattaattctatgcctctagaatccccctcaaccaattccactaacatatcctgatcctgatcaccaagctctttcaccctgactgcagcaatagcaatcctctccacttactgctgtcctttattgatctatattttctacatcagttttcccctgaagggcttgttacaacacactgcgtgtgtggcggggaggtgaggtagggtgggagggccaccccgtcattcagtgcattatatgtattcaatacatattattaactaaatatatgttacaataatattaaagcacatattaaatattctacactatgtgtgtaaagagactgtgttttgtaaattgtaggcaaagttgcacaaaatgtgagatagttatgaagtggattaatccattaggtcactgggaattcacaaaagagggatagtgtgtgtgttgggggtgattcttgatgtctattttattttgaattcatctacactatgtacctgaaagtcatctacaaatcaagaataaatatcctcaaccttctgaaacaaagaatcctcacttctatttttacccctttaagttttctcggtaggtgctgtggttatcctgtaacagacactagggaagtttaagctacaacaggtactaggtaacaccttaacacctttagcaccatctatttttggaaacaagtggactataatacaagcaaatatcatcttatgttttgcttagtatttggaattttcaatgtgtttttacccacaactttcggtttgatctttatgtacgtgtgtgtgcgtgtgcatgtatataaataagtgtatatgtatatacacttttttaaaaaagacacttattacatgagctctaaaaattactttccccatgactgaagtgttactacctgcaaaaaatatgtgcatataccatgtccatatatatgtgtgagcataactatatatatgtgtgcacatgcatatatatgtgtatacacttatatgtatcctgtaacatataatatacagaattctatatattctgtaaatatataagtattatatataatatatattgcatattgaaaattccaaatactaagcaaaacataagatatttgcttgtactatatacttataagtgtatatatatatacacttatatataagtatatatatgtaagtatatacacatatatacatgtgcacgcacaaatatacacttacatatatatgtatatacttatatacttatacatacatatacttatatatacatatctatacatatatacttatatatactaagtatacttatgtatacatgtatatatacacatatacatatacatatatacacttataagtatatatgtgtatgtatgtatatatacttataaatgtatacatacttataagtatatataagtctgtatatatacttgtaagtatatataagtggatatatacttataagtatatataagtctgcatatatacttgtaagtatatataagtgtatatatatacttataagtatataagtgtatatatatacttataagtatataagtgtatatatatacttataagtatataagtgtatatatatacttataagtatataagtgtatatatatacttataagtatataagtgtatatatatacttataagtatataagtgtacatatatacttataagtatataagtgtacatatatacttataagtatataagtgtacatatatacttataagtatataagtgtatatatatacttataagtatataagtgtatatatatacttataagtatataagtgtatatatatacttataagtatataagtgtatatatatacttataagtatataagtgtatatatatacttataagtatataagtgtatatataagtgtatatatatacttataagtatatgtgtatatatacttataagtatataagtgtatatatacttataagtatataagtgtatatatacttataagtatataagtgtatatatatacttttaagtatatgtgtatatatacttataagtatatataagtgtatacatatatatgtatatattagaaaatccttcacagcagttctgtttattctcctgtaaaaaagtatgtatgagtatataagtacatatactcgtatatatacttctatagacttataagtataatacttctaattatataagtatttactatatatacttatatattacttatatatattacttacatattacttatatataatatataacttatatattacttatatatgttatacttatatatattataatatatattatatataatatataacttatatataatatataatatataagtaatatatattttatattacttatatattactcatgtaagtaataaagaagtaatagatatattacttatatattatacacttatactatatatacttatatatttattatgtatacttatatatgtataataagtgtatatatacttataagtgtatatatacttataataagtatatatataagcatacatatatgcttataagttagaaggtcaggtgctaaccccacgatttcatatagccattgagatctgcatcttagttcagtacttgttctactgcgtaaagctatctcaagtactgttcaagcattctttcttttcaaatggaacatgacagacagaatatgaataaaggtagtttgaggaatgcatgtatattgagaaatttgaccaacagatctaaaaagtatctcagataaatttcaaagacctttgcaagtaaatattaacttggtatttttagtttcaagaacaaacagaatagtatttatttttactgtacaccaattataacttattagatgcatacaattaaaatctacgaagacatgtgtttcgttttattgggaagcataattccatgttgatatagtataagtcattcctttattgcctgaaggtatcttcactaataggtaaagatttgacaatacaaaagcagagttcgtatttttcaagaatctataatggataagcatctaagattacaacaaacgatgtcacaagatatctggaaatatggttccaataaattcatttaaaaatagattagtggccaacttctgtttactctcgactgtcacatactacataatattagtcttcaaagtctgttgtgtgttgagaagtaaaatttcatctgaaaatatctgcattttctacttacctgaggtatcttgggcctgttgacttcttctgagattttctctcaatagccttataacttccttttgatattctacagtggcttttgtagcactgattctaacaaaaacaataaaaatatgtaaaaagctcagcaactgattttttacaggagaataaacagaactgctgtgaaggattttctaacacatcacattgacataatgcctgtaagtggcagtagataagccctcgtgatacctctctggtgccatgtgccttatggcattaatgccatcaaactagaagcattctgcttgggtgcagggacagtccgattttcttatattgagaaaccccagttcttttaaagcttctggaggcctaattcattgtatattgaacaaaattataattacctaattattttttaccatggggtcctagaaatatttgaaggtataaggagcatgaaagagaaagtgcagctttatttctgtatggtcaggaaagcaaaccctgactgcagctctggtctaaggtgctacaaaggtcaaattctgatcactgttctccagtagaaagagacattttatgagttgttagtttacgcattaatcagtaacgataaattataagactttctgcctttcttaatgactatgaattatctgtatctgctgaccctattctttacttttcttttctttttttttttgagacgaagtcttggtcttgtcccccaggctggagtgcaatggcgctatctcagctcactgcaacctctgcctcctgagctcaagcgattctcctgcctcagcctcctgagtagctgggattacaggcacctgccaccacgcctggctaatttttgtacttttagtagagacggggtttcaccatgttggccagactggtctcaaattcctgacctcaggtgatctgcctgcctcagcctcccaaagtgctgggatcacaggcgtgagccaccgtgcccggccctgctgaccctattctacaagtaaaattgtttttataattaagaatctaatagatctatgtttcactgaaaccaatagactgcttagagagcatgaaaattccaatgctacttcctgggcaaaataagagatcattaaatatttattcaagatttatataggaagaatgaaaagtgttaaaagccaggaagcatcctaacaaatcctctaaataaacctttccttattgattatgaatgcgaggaccagagagaataaacagtgtaaggtgatgcattagtaagtgagaacatatttctttttttttttttttttgagatggagtctcactctgtcgcccaggctggagtgcagtggtgcgatctcggctcactgcaagctccgcctcccgggttcacaccattctcctgcctcagcctcccaagtagctgggactacaggcgcctgccaccatgccggctaatttttttggtatttttagtagaggcggggtttcaccgtgttagccaggatggtctctatctcctgacctcgtgatttgcccgtgtagccctcccaaagtgctgggattgagaacgtatttctacttcagtttccttgactctctttaatgttcttttcattatgctataccacaaagaatttaggcatgctgttatgtataatgctacctataaataaatcaataaaaagaggatttgctcttgggccctagggaactataaactaaaaggaaatataatcttcacacagaaacacagtaaggccaacaaatgaaattaagagaaccaacagaagccttagtaaaactgctaaatacacacacacacacacacacacacactcttaatgttcactttcaggcatacaaaagccacttaaaattgtttatattctgtatgactaagaagtgttcaaagacacagcgtgttaattgatcagaattgtgtttagttttaaaaactttgcatatgtaatgagaccagtatatttaaaatctatggatgtgtacatttttaaaaaaagagctgtaacaatattttcataaattatattttaaaaagttaactaatgaaaagtatatgtagtttaggaagaaaatttaagctattaaaatcacattaaattaagacaaatacgtactccttttcaaattctttggcatttttcattttctctaggtctattttcacaagcttcattttgagatcttcaatttcttctttatatggcttagctcctaaagcaactttgtcctaaattttttttagagaaaataaaaataattattagaggcgcttcagtttctccagttgtaaagaatggttagctgtctttgctctaataaggacattttaaaatagcaaacaattccaaatatatgaaaaagcatcaattttaactgaataactagatattgatatgaagtctatttgaagctaatatgcaattagaaacatgattttttatttggagctatcataatatgcaattagaaacatgatttttatttcttaaaataaatattttttttctaattgaaaatacctacaaaatgaaaaaagttggaaataatgaaaagggtggaaaaaggtaaatcagaaaatgaaacaaaaagatgttggagcagtgatgtaaacatcaaactagaactaaatttaagccacaaaacaaagcattactaagtatattttgtactgaaacagttccatccagtgattcaaaacactatattttacagcagcaggtttccagaaaaatggaatggaaaatactgggagttcctacatacccagtgtcccctattcctttttccccatattaacatcatgcattagtatgctgcatttgttataagtgatgaatattgatacattattattaaaatctataatttccatgacagtttatttgtattgtacattctgtgggttttgacaaatgtaaaatggcacatgtccatcattacagtatcatacagaatagtttcactgtcctaaaaaaccccgtgctttgcctattcatccctctcttctccattatccctggcaactgtttatttttttactgtctctgtagttttgtctttctaaaaatgtcatatacttgaaatcatacagtatgtagcctttccagattggcttctttcactaaccaatgtgtattaaaagtccactcattttctttcctttttttttttttttttttttttaagacagagttttgctctgtcacctaggctggggtgcagtggtgcgatctcggctcactgcaaccttcgcctcccgggttcaagcgattctcctgcctcagtcccctgagtagctgggattacaggtgcttaccaccatgcctggctacttttttgtatttttagtaaagacagtgtttgccatgttggggaggctggtcttgaaatcctgatctcaggtgatccgcccgcctcagcctcccaaagtgttgggattacaggcatgagccactgcgcccagccctctcatttcttttaattgctgaatactattccactgtatgaatgtaccagtttatccatttacccactgaaagacagtcttagcaattatgaacacagctgctattaacatacacatgcagccctttgtgtgcacatatattctcagctcatctgagtaaataccaaggaatacaactgctcaatcatacaagtatgcttagttttgtaagaaactgcgaaaccatcttccaaaatggctgtaccattttgcatttccactagcaattaatgagaattcttgttgctccacacaccagcatttggtggtgtcaatgttttggattttggctattctggtaggtttgtaatggtcgattattttaatttgtgattctctgatgacatatgatatgaagcatctgttcatatggttatttgtcatctgggtcttttgccaattttaagattgattggttgtttcctattgttggttttaagagttctttgtatattttgtataacattccttcaccagatttatcttttatatacagtttctgccagtctgtggcttctcttgattctcctgacagtgtcttttgtaaagcagaagtttaagtctcaataaaatccaacttaccagtttttttctttatggattgcacttcttgtattatatcttaaaaaatcgccaaacccaaggtcacttagaacttctcctatgtcatcttcttggagttttctagttttgcattttacatgtatgcctatgatctattttgagttaatttttgtgaaaagtataagttctttgtctttttttgcttgtggatgttcagttgtctggcatcattagttgatcagactatccttttcccattgagaagcctttgtttccatctctcccagaatagaaatgagagttcttaaaatagcttacagggcctttatgatctggtcctctgctacttctcaccttattttctacctctatcctcttgcttattctgctctggatgcacaaactttcttgttgttttcagtttgctatttcctttgcctggaatatttctccctggctacacagttcaccctatcacatccttcagatcatcttactggtgtgacattcctcaactcctgtatatacaatcatctctcttcccacacatgtccactttcacccagaaccatgtacccccttgtctggcttaattttttccatttcacttttcaccacttgagatataatatacctcttaatatatataacatatataaaaatataccttctatgttttacatttttaattaatattctgtctccttcaactagaatgtaagttccttgatggcatggtctttgttttttcattggcctctagaacagtgagtgacacatagctggtgctcagcaaatatttgttgaatgaataaaaactgtgatcaattatttgtaatattaaaaaattacaacattctaaaactttacagttgaatttttttagtttctagctataacaattgttgaaaaaacaaatttaattttttcttttgcctctctgctcatgtctcactgaatagaccagaatttttagaacaatgttaaataatgaataaagcaggcattcttgacgtgttcctaattttaactggagagaaaagacactggagcagaacagcaaatttaaatatgccaatttggatcagactcgagtagaagaaatgtgggaagtggctggaactaaaacaagagggagctgtaagtagtgattaatgagtgtgtgatttgtctaatgacattcaagttgaaaaacatttcagttacggttcttccccccaaaacaggtcagattcagcccatgggatatcaggtgggactcagtaacagaggcagtaagtaggaaaaaaagaatttaaaaatttacttatctaatagtattatatattttgataagcaatttttgaaaaatgaaaaaatatacactaaactataaacaacatgtatatcttaaaaattattcttccaacataataaaaataatattttatatgacaatatgctcctacatttcacttctaagttaagctgcttctgcttgagtactgaacttcagaaacacataggtaacagtaagttgttgtgagagggaagaatagagcacaaggagatttgctgaattcaataggttaaacaaacaaacaaacaaacaacttttatttttatgtttaagttacctgaagtacttgaattgtctcttttgttttttcaaggcatttatttgattcatgaactttggcttgaagttttgctattatgtcattagtcacctcaagttctttctgcatctttataatcttgctttccttatgcatagcactttctttagcttcatgcagtgaattttccagctctcgaattttctattagaaaaagcacacattcataagctctatcatcaagacagaatcacagtatagaaatttgagacagagatgatcatatttagatattgttaatttttcacagattgtattaacaatggatagaagagaggccaaacatcattcaatctacagacatgttatttccctcatttagatgatgatttttggattgaaaatgtcaaaggtttatattataatctgtctgcaaattcttaaaacatgcagttaaaaacagcacagtggttatgcgatttattagttagcatagtgctaagcatattaaataggcactcatattttacatgaacaccacttaaacaaaggacattggttaattgactctctaaagtaatatatatttatctttccctttaattttattaattttttttttttgagatggagtcttgctctgttgcccaggctggaatgcagtggcgcaatctcgactcactgcaacctccacctcctggattcaagcgattgtcctgcctcagcctcccgagtagctgggactacaggtgtgtgccaccacgcctagctaatttttgtacttttagtagagacggggtttcaccacgttggccaggctggtattgaattcctgacctcaggtgatctgcctgccttggcctcccaaagtgctgggattaaaggcatgaaccaccatgcccacccttattaatcttaaatagaaaaacacaaatatgtggaaaaaaattcaaagacatataatgaagagtaagtctccccatctcagacccccagttgaccctgaagcgatgactactaaactttttcaggtgtatccttccagaaattttctatctataaccaaatatacatgaatatatagtttctaaaaatagtatacacacaatatactaaatatagttctgctttattttaaaacttgagaacatattttttccagatctttccattatcaacacatagatctctcctattttttgttttcatggacatatagaatctcatttcataaaggtatcatataattcacatgtacacactcttttttgtttttggcaaaatgtctggatttttgggggcccatttagaattcatttttgtttaatgaatgagataggaatccagccttacttttttccagatggctatcctgttgtatcaaaataatgcactaagcaaaccatcttttctttctttctttttttttttttttttgaggcagtgcctcactctgttgcctaggctggtgtgcagtggcatgatcatggctcactgcagtatcgatctcccaggctcaagtaatcctcccagctaagcctcccacatagctgagaccacaggtggatgtcactgcacctggataatatattaaaaaaacacttttttttttgtagagacagggtctcactatgttgtccaagcttatcttaaactcctaggctcaagtaatcctccaaccttggcctcccaaagtactgggattacagactcacacacctggccaagtaaaccatttttttttcccactgaattgaatgttactgttatcatacacctgtactaaattctcatacttaattgggtatatttctgaaccctctattctgttccactgctctacttgtccatttttgcatcaaacttgtctaatgatagtagcatgtattttattatctgctagactattttctttggtcattgaagattgaccaactttccttttgcttctttaaattactatattggtagatggatttcatctttcctctattttatctgtagcagctgactgaggtctgtaatgccctacaaatcaaaacactgtatactagtgatctagttctcattaagctggtggttgatgttttattataagtatttattttggtaaaaatgataaattgtaatttactattgggttccctacaagtcgttttgtgtgctaacaaaatacaacattttacgcatgttgttagattcccgagtaagggtagttaataaggtaatttggttatcaaataatgtactggttcttagatacaagttaacctgcgtaacaatcttgttatattttttaacctcttatatttttattgtgattataacattaagcaatattaaatacgctgatgataatgagaaaagctgaattgctatttctctccaagctaatatttgttctgcatacggacatagatcacagttcaacagaaagtcacataatttggaaaacttttgtggtaattgtacgttaactggtagtaacttaaactatagtttatgaatgtaataatcaaatgaagctacaatttatgttttataataatatcttacataatgtctagctttataattagtttagttgaacgatagccatagtagaactactagtaaaaatcaagcccatcacttacaaaaataaatgtgttcatgttcagtaataagtaaatactataattttgctctaaactctgtgatgaagctgcaaactgaagaacattttataagaaattatatacctctgtggttaactgtgtagctcttgatgtaacatgaggattcttattgtcttgtgtggtaggattaacctgggcaccagatgccaaggaagtcttcaatgtttggtagtttttaaatagtttttcatttttctctttcagtgatttcaggtcctgttcccactctttggatatggtagcacttctttcctcaaactctgttgattcattcattatggcctattgaacagtaaaataccattatagctctaaaacgatttatagtagtccccacttacctgcaattttattttccatggtttcagttaccctcagtcaaaagtggtctgaaaatattaaatgggaaattccagaaataaacaattcacaggttttgaattgcacatcattctgagtagcacagtgaaattttgagtcatcctgctcagtcctgcctgggatgtaaatcatcctcttgtccagcatacactacttgttcacttgatagccaccctgattatccgattgctgctgtattgcagtacttgtgtccaagtaacccttattttaattaataatggccccaaagcacaagagtagtaatgctggcaatttagatatgccaccgtgaagctgtcaagtgcttcttgtaagtgagaaggtaaaagttctcaacttaataagaaaaaaaatcatatattgaggttgctaagatctatggttagaatgaatcttttatccgtggaattgtgaagaagggaagagaaatttgtgctgtttttgctgtagcacttcagcctacaatagtgtgtgataagtgcttagttaagctagaaaaggcattaaatttgtggtagaagacaagaacagaaatgtgttccagttgatgacaatgtgttgtaccagcaagcattgagcatctaggaagacttcagcaagggatcccctgaaaaaagtgacaccaagccctttactgcaagtaagatttattcatggattcaggaatacagaaggtcaatagtagtctaagactatatcaaaatgtctaggtcattcatattccttcatcttatcaggtaggcactgtatcatctcacatcataagaaaggagagtgcagtaaaataagatattttgagagagtccacattcatataacttttactatagtatattgttaaaattgttctattttattagctgttgttactaatctcttactgtgtctaatttataaattaaactttatcataggtatggatgtatagaaaaaacagaatacatagggtttggtaccatccatggcatcccctcgggggtggggggtcttgatatacatattttaaaaaaacttcaaaaaaccctagaattctaggacagtgtatatgctgaagttcattatttagaacattctaaaacagtactttaaaagaatgtgaacattctttgtagtttgcatcagtttctgaaatttcagatgttggatgtggatgatgacaataaaatgaataatgactagagaggattcatattgatctgcaagatgataatctcactttattagatttgtactaacatatgaagagaacctgaagaattatccaggttaaaatcattatatatgctatggctgataatgaaacattaactgatatctaatagcagagcacagctagaaacttaacaattatctattgtcctgcttcattacaaacctcaatgttaatagggaaaataactcactgattgttggtaattaatctgaatatcttgtatttctgtacagggaataacaatactcttttatattgaaggctaactaactctgaaattattgatatcttttttacttcctaattcctgcagattgtactttctgctctcatcatgaatgccccattagtctcatccctaacttctttgtggctttgtggtcattctaccaggctttgtggtcattctaccagatcttaaattcgtcgtgttcctgacaccctggacactccttggctctggactatgcacctcacaccataccaagttattaatgcctactcttatgtgctggaagaagccacatatacatgctgatccacatagtagaaatccctgctttctaatcacaactgggtctccagtattacaagaaaaacaacaaattacaaatagacatgaccttatccaaacattggttttgtgcctttctctactgattgtggacttctttgttttttcttgaaatagccaactgctatttggctagctctgactaatcaataaacaggatgaactttccaagcgaaaactttttaaaaaaggcattgttccttatttcaacaagattccaatatgatttgcagatgaaattaaattgtcagaaaagaactatccaaacatatgaactataaaatgtattttggaaactataatattaatctagctaccattgctccaatttaatataaataagcaatcttttgaatattacatgttttaccaatgaaacagagaagggattacttctgaaagcagaatgaatactgcaattacttttgtacccaccaaataccaatcactgaaatgtaaaacaagttaacaaactggtcttaagcaatgttggtccttatgactcagtacatttgggctgatcaccttgggaacaatgattaaaaaaaaaatcaaaattttggaatttctagtttagcattttaggtgtttagaagttgccagtccaggacgggtgcagtggctcacacctgtaatcccagcactctggcagtccgaggcgggcagatcatgaggtcaagagattgagatcatcctggccaacaggtgaaaccccgtctctactaaaaaaaatacaaaaattagctgggagtggtggcacgtgcctgtagtcccagttactcgggaggctgaggcaagagaatcgcttgaacccaggaggcggaggttgcagtgagccgagattgagccactgcacactccagcctgggtgacagagtgagactccatctcaaaaaaaaaaaaaaaaaaaaaggagttacctaacaaggaaaaagcaaaacaaatgaaaaaaatccacaactctgcttagatccatcagagaagtgaggtcgcagggcaaagggatgctccccaaactggagaggcagagaggcagatacagagaattacaacttagagcagaaaccctttgcaggaaccagttatggggtaggaaaacctgaactgcaatgatgaattattggagctcagtgtggcaactctgagagttaaaaacttcggagacctagtcatacagtggccgccacacttttgtattttaccttcaggagctctaccaagtcatcacagttaatattggagaaatccctttgtgagtctggcaggagaggagaaaaggaaccattttaaaacaaaacacagcattttttttttcttaaggcctgacctcagcagaaactatttcaccagagcctaacatgctggggttttgtcagggcctaatatatctggaggagggggaaatactaagtttcagctggctcttgccttccatgtgaaggcagggaaatatactccgcctgccacccaccacacacaccttgccactacattactaaaggcctatttgctacagttacttttacccagtaaatcatgcctgcttttcagcaaaaaaaattacaagacatactagagggcaaaaaacacagtttgaagagactgaataagcatcagaaccacaggcagaaatgccaggaacatgagagttatcagaccagaaatttaaaaaaaatggattaatatgctaggggccttagtggaaaaagcagacgacttgcaagaacaaataaacaatgtaagaagaaacatagaaattttgagcaaaaaaataaagaaatgctagagatcaaaaatgctcttaagagaaacgaagaatgcccttgaagagttcattagcagactggctgaagaaagaaactcaacttggaaatatgacaatggaaacttccaaaactgaaaagcaaagagtaaaaagactgaaaaaatccctaaacaacatcctagaagtgtgcagtaattataaaaggtgtaatgtatacataatgggaataccagaaggtgaacagaaaaagaaagagcaggaatatttgaagtaataacgactaagaatttccacagattaacaacgtacaccaaaccaggaatccagaaaactcataatgctaaacgggacaaatataaaaaaaaaaaaaaaccaaaaaaacccccgaaaaaaaacccccaaaaacaaaaaacaacatctaagcatatcatattcaaacttcagaaaaatcaaaggtaaaaaaaaatctttgaagaagctagaagggaaaaaacaccatacctataggggagtgaagataagaattacatctgacttctctgaagctattcaagctagaagacagtggagtgaaaaaacatactaacctataattctattccatgtaaaattattcttcaaaagtaaagtagaaataaagactttctgagacaaacaaaaatggagggaatttgctgtcagtagactggtcttgcaagaaatattaaaaagaagttcttcagaggaaaggaaaatgatatagccagaaactcagatctacataaagaaaggaagagcacaagagaaggaataagtgaaggtaaaacaaaaacttattttcttattcttaactgagctaacttatgtatgcttatgaataagtgaaatgaataacggcaatgatacaatggatgggagggagaaattataaatattttgttattataaggtacttatattatctgtgaagtggaaagtgttatttgaaattgggctcagattagttgtaaatggatatattgcaaactctagagcaaccactaaaacaagatagaagtgtagttgtatgctaagcagagaaaatggaatcataaaataatttaaatcataaaaggcagaaaaaatgtggaagacaaaaataggtacaaagaataagggcaaaaaatagaaaacagaaacaatatggtagatattaatccaattatatcaataatcaccttaaacgtcaatggtctaaatacaccaattaaaagaccgactgtcaaagcagatcaaaaaataagagctgactgtatgttgtctacaagaaacccatcttcaatataaggacacatagattagaaagtaaagggatggagaaagatacaccatgttaaaactagtcaaaagagatgaagtagtgatattaatttcacacatagcagagttcagagcaaggaaaactatcagggataaagggacattacgtagtgataaagacatcaataccccaagaagacataacaatttttattttgcatgcacctaacaaaaacgcattaaaatacttgaggcaaaaactgataaaactacaaggagaaatagatcaatttattatagttggagacttcaacgcctctctatcagaagtgaacagatccaccaggcagaaaaatcaggaaggacatggttgaatttaacagtaccatctatcaactggatgcaattgacatctattgactacttcatccaacaacagcatattatatattcttctcaaactcacattgaatatttgtgaagacagaccacattctggaccaatcataccattctgctctcagaccacaatggaattaaactagaaatcaaaaacagctgaaaaatccctggataattagagatttaaaaaatacatttctaaataacatacgggtcacaggagaaataaagagaaattaaaatgtattttgaactcaatgaaaatgaaaatatgacttatcagtatctgtgggatgcagtaaaagcagtgtttagaggaaaatttatagcattgaataccagtattagaaaagaggaaagacctaaaaaccaataaatgaggctttaaccttaggaaactaaaagtgaagagcaaattaaatccaaagtaagcagaagaaataataaaagtagaaatcaatgaaattgaaacaaaatcaatagagaaaataaatatcctaaaaactggttctttgaaaagatcaataaagttaataaacctctagctaggcaaactaagaaaaagaaaaagaatacaaattactaatatcagaaatggatgacaggacatcactatagagcccatggacattaaaaaatattaggaacaactcaattattacaacccacaattatgaacaacccacaaatttgataatttaaatgaaatggaccaattctttgaaagacacaatctaccaatacacaagaaaggcagttcgattaggcctatatctatcaaagaaatggagtcagtaattaaaaactttccaaaacagaaagcaccaggtccagatgagttcaatggtgaactctaccaaatatttaagaaatttaaggaaaaaactatacccattctctacaacctacaatctcttctagaagatagaaacggaaactcattctatgatgtcagcattattctaatactaaaaccagatgatgacattatacaagaaaactacagaccagtatctcccataaaaagagatgtaaaagctgggtgcggtggttcacgcctgtaatcccagtactttgggaggccgaggtgggtggatcacgaggtcaggagttcgagaccagcctgaccaacatggtgaaacccgtctctactaaaaatacaaaaattagccaggcgtggtggtgcgtgtgtgtaatcccagctgaggcaggagaagtgcttgaacctgggaggcagaggttgccgtgtgccgagattgtgccattacactccagcctgggagacagagtgagactccatctcaaaaaataaaataaaataaaataaaaaacaaagatgtaaaaaaagatgtgaaaatctcaacaaaatattaggaagtcaaatccaatcacgtgtaaaaatgattatacatgaccaaatgggatttatcccaggtatgcaaggctggtttaacattcaaaaatcaattaatgttccatcacataggctaaagaagaaaaatcacatgatcatatcaatggatgcagaaaaaatttgtcaaaatccaatacccattcataatttaaaactctcagcaatagagatgaacctctacaacttgataaagaatgtctacaaaaaactacagctaacatcatagttaatcatgaggaactagaagtcttcctgctgtgatcagaaacaaggcaaggatgtcccctctcacctctagttttcaacactgtactggaagtccaaattaacgccataagacaagtaaagaaaatacaaggtacacaaatttgtaaagaagaaataaaacaaaactctctttgtttacacatgacatgatcatctacatagaaaatctgaaggcatcaacaaaaatactcctggaactaaataagcaactatcgcaaagttgcaggataaaaagtcaatatacgaaagttaatagctttcctgtataccagcaatttacaagtgtaatttgaaattaaaaatacattaccatttatactagcaccccccaaaataaaatacataggcaaatctaacaaatatgtacaagatctatatgagaaaaactaccaaactcttataaaaaaataaaagaatcaaataaatggagaaatattccatattcatggataaaaagacacgatattgtcaagatgtcagttctttccatctataaattagaagcaatcccaacaaaaccataggaagttattctgtgaatagggacaaactaattccaaagtttatatggagaggcaaaggacccagaataaccaacacaatgctgaagaacgacgtcagagaactgatgttacttgacttccagatttactataaaaatcagcagtttccagatttgctataaatgaaagaacaaatagatcaatggaatagaatagagagctcagaaatagatcccacatagtcaaatgatcattgacaaaggagcaaagacaatataattgtgctgaatctggacttctacaagcgaaaaaaaaaaaaaaaagaccttaagaacttcagaaaaattaactcaagatggatcattggtttaaatgtaaaacaaaaactatggaagacagcataggagaaaatctagatgatcttgggtttggtgatattttagatacaaactcaaaggcataatctatgaaagaaataattgataagctagacttttttttaacattaaaaatctgcactctgaaacacaatgccaagggagtgagaagacaagccacagattggtagaatatatttccaagacacatctgataaaagaccaatattcaaagtatacaaacaattcttaaaccttaacaatgagaaaacaaataacctgactaaaataagggcaacagacctgaacagacacttcaccagaaaagatacacagatgacaaataactataaaaaatgttcaacatcatatgttattagagaattgcaaactgaatgagataccactagaatggtcaaatactacacttactacacttactagaatggtcaaaatcccaaactgacaacaccaaatgctgatgagaatgtggagcaacaggaattttattcattgctggtgggagtgcaaaatggtaccgcccctttggaagactgtctggcagtttattacaaaactaaacaaacttttactgtatgatccagaaattgcattccttgatatttactcaagagagttgaaaatgtatgtccacacaaaaagatacatatgtatgtttatagcagctgaattcataattgccaaaacatacaagccaccaaaatatcctttggtaggtaagtagataaacaggtacatacacacaatggaatattattcagcattaaaaagaaataagctatgaaaccatgaaaagacatggacaaaacgtaaataaatattactaagtgaaagttgtcaacctgaaaaggctatatactgtatgattccaacatatgacattctggaaaaggggctactatggagacagtaaaaagattaacagttgccagggtttaggaaggtgaagtgatgaatacaggtggaacccagggaatttttatggcaggatagtaaaattactctgtatgatactgtaatgatggatacatgtcattttacaattgtaactcatagaatgtactatgccaagtgtgaaccctaatgtaagctacggactctcttgggtgataatgatgtatcaatgtaggttcatcgattgtgccaaatgtgccaccctgatgtgggctgttgataggggagattgtgtttgtggagatggggtataagagaactctctgtactttctgctcaattttgctgtgaacctaaaactgctcttaaaaaaaaaagtttattaaagcacatgaggcccatctaaagtagctggccaggcttgtctatgactttaccacagttgctgcccatagcttgaaacagactcatgtcttacgatctctaaggctactcgtggaaaaggctcagttcttacagaagcagtgagaaggagaagaaaaagaggacaatagtaagaggattcaagatttcacaagtggaaactaaatattatacaacaagatttcgttaccttgatcagtatgaattgataaggaagaataatacattagaggaagaacacgttttatcaaatcaatttttttaaagcatatacaaataaagaaaatatacataagttgcccttttaagaatgaggtaggacaattaaagcaaacagcaacaaaaaagtagtacagcaaaaagtaatacttacaattattctgttattaaagaagttattcacttgacaaatcctatcattttctttctggatgccatttttaagcttttctatatcaaaacgagtatttaaccactcttccaaaaactgtgtcatttctttcctattacttagtacttgttgaaattcagtctttatgctagggaactcactttctgagaaatctttgagaatttcctgtgtgaaaaataagcgtcaaattgtttaaacattaggaaagttttgatccaaatattttatttatatatatatatatatatatataaaataaaaagagggcaatacctagtggactcttgcttttcttccttttaatatcatttcttaatattttaaagtaaactaagaaatataattgtaagttaaaactttattctagttatttgcataatataattttggcagtatacatgatgtaacagattgtacctattagaattaaagcttgtcaaaatgacaaatttgtgactaattgctacaatacctgaagtgcatcttaatttttattttttgagatggtctcactatgttgcccaggctgatcttgaacccctggagtcaagtgatcctcctgcctgagcctcttaagtagctggaattacaggcatgccactggggctggcttcatgaagtgcttctaaatgtagcttttcagtacatatagcagaccttacatacatgttgggaattggatgccagcctcacatagatgaatgcaagtaacacattccatgtggagttgttgtaataaagcggtttctgactcccagcatagacataagttttcctgtatctattgaggtctgaagagaggctagtccattatttgccagtctttatgtctggccaggtatcactctgcaacgtatttttaatttctggtaaatgaaaatagctctaagcacatgaaaaagtacctttctacttgataaaaaggcttaaaatctaactaaatccatttaaaataaattatacctcaatatgtagatccatattctggttcaatttgagatcccttaattctctggatggtacatcacaatcttgttgaaggtgctgtattttaattagcaattccttttgcttttccacttcatcaataaaatccatttcaaatttattgatggattcatgttgttcttcttttatttttgtaacatagcttaacacatacttgcagaaaaaaattaaacaaattggtaaatgaaaattttgtcacatgtagagaaagttttcatccttgagactatgaggtaggatgacatctcttatttacctatatcctctcacaagtgaggaaaagggaaagagcttctctctatccccagtttttcctcttagtatcttaggagaataactaactcccagacctataattccttatttctgacttcttaccagatatacttcttggatgtcttacaagtacttcaaattcaacatgtttaaaacgtaacatgatccctttctctacaagtcctcctttttctattgcccagtttttggctaattacattaccaatcacccaggtttcccagttaaactcatgagactcattttcaacatcctctcctgccaacgctgattgggtaaccaaaaagatgaagttacatgcctcaagacttccttgtcggccggacatggtggctcatgcctgtaatcccagcactttgggaggctgacgtgggcagatcacaaggtcaggagttcgagaccatcctggctaacacagtgaaaccctgtctctactaaaaatacaaaaaattagctgggcgtggtggcaggcgcctgtagtcccagctacttggaggctgtggcaggagaatggcgtgaacccgggaggcggagcttgcagtgagccgagatcatcacaccactgcactccagcctgggcaacagagcaagactccgtctcaaaaaaaaaaaaaaaaaaaaaaaagacttccttgtcaagcatatttagatatttggcttcaagagacaataatttcaatgccaaatgtctcatggacttcatgaataattctagatgtctgattaccaggatttgtggaagaattaccagggcccgaagggcaatctacccaggtagggcagataccagcttacttattcctcaacttccaccattccttaacctcttataatctggtctcttccttaactacccagttgaaactgttctctgacaatgatcactaatgagttctattatcaccacattgagagaatatcttcagtccatattctgactctctgaagtatttgccactcataacttcatctttgacatactcttctccactgatttgggtagcagtacttttgctagtttctctcctgtatctttgacttttccaaccttgaacccatgtgttgctcccttttctgctactgcctcttagacatttatcttttccagagttctgtttttatcccaaggctcttagtcttcattatgctttctggatgatcttacaaatgtattatctatcacctatatgctgatcagtctcaaatgttagttcttatttttctcctgccaaacctcaaactcaaatctaaatgtctacttggtttctcttcttggatgttccatcataggtatttcagcccccaaacatctcaaattaaacaatctcctgcctcatctaccttgtttctctttcttttttatttttgaatctcagttaatggtaccactatcgacaaacctgactaagcccaaatccaagaactccatctaaacttctctcccttatgtccactatcaattatttcgacctactattttaagctgctaaatatttctttaatctcgtttgtcctctccagccctgtgaaaccctccctagtagtacagtcacatataatatctcatctggaccactgtaactgcctcttattgctttctgctactaggcttatctccctcaaactcatttcttctgtattctttagtttagtacctaagtggtaatcagatcctgttaccaccaccacttaaaacaatagtctaatgattccccatctacaaaaagaactccaagctttgttattgagtctggcttctactacagtttcatcttctgtaattttatttagtacgtcatataacttgcatacacttctatcattgcacttaatacttgtttatatgtctgtctcaccccagactatgagatctttgagatgttaactcacatctgcctcctgaacatcctgacataatgtctaggcccacaggcagagttcaggtgttgctgatatcctacatattactatgctcagacccacataatctttaatttggtagtaagaatactaaatagcaaatatgccggcacctgaagcaggacttaaatacattgatgtttataactgaaatatttaaaaggatattactaaaaaagatggtaccttcagtttcttcatgattctgtggaattccatggagcatctctggtttgcagtaaaaagtttttcaatgtgtttggtttgtaaatagggaagtgagaggtttgctttaactctcattgaaagctctttttggaattcaatttccttctccaagtcaagagacaatctattcaagcactcataatgatcatccatctctgagtatctcttcaaaagctcctaaaggaaatgagaattcactcaatttataacaattcattctaatatcacaataagtagttacaactctagaattgtaacaaaacttatgctttaacattttctgtaggagagaaataaagacctttgtgtctaaaaacaaaaggaaactcttgttgtcattttggataacagaaataatagataattattatggcaatttaaaaaatttaagcaaatataacaaagaaagccaggaccaaccattcttaacattttgatgcattttcttttagttttttgaatatccatgatatgaatcaacattgacaaagtctgatgagaaatttgagtaaattcaattaagtatgtattgtagttcatggttgagtgctggtttatgtttatagtaggcagtctgagttagcagataaaacaagtgattaagaatcaaaccacctatttgtcagcttggtacagatacttcacacaatcctactatctgcctacaatctgttttctaaccctttatcagaggtagagttcaggttccagctctgccacttcttgactggggaagtcactgagccattttcacaacaacaggaagactacaataattaccacaaagttttctggggtcaagtaaaatatatgatctatacctatatacctatgtaatctataaaacagacacagtcatttaacttgaaggagacaaaattatgtttataaacatgtttctatacccaagttttgaactaagtcagatacaagtctgacttagtttaaaattctgattctaacaatttactagctgtgtaaccttgggcaactgctaaacttcctttctgaggaaggcagtttccttgtttatgaatggagcaataaagcctatatcatgaggtaaagcacccagtatggtacctggcatacagtagacatgcaataaatctggacccatagactcaagtgacttgaggctatgcaggtgacacactggtcagagcacaggtagagaaacatgtaaaattcaagttactgtaatcatgtagtaggtaacatgtttagttcaggctgctaaacaataaaacaagggcgttctcacaagaatgagccctttatttttaataatttaagaaaagctagatgttaatcaatctggaatgttggagaggggattcctgtttttggttttaggatgaatcaactacggtatacagcagcatattgaacactgacttatgtcaggaatgtgctaaatgatgtagtcataaacaaaacaaaaatgtccttagagatcttgcattccaacaggtgtgactgtaaatcctgttggctttcccttcaatgtatattcagaatctcaacacttctcactacctctattgctccctctctgggccaggccaggatgatctctgcctgggtgattgaaatcagtctttataatggtcttcctgcttccactctattttcaatataacaattaagagtcatccctttaaaatgttaagtcagattatgtttctcttgcggtaaaaattccccaatggatctccacctcacttaataaaactcagtcttttttcatgtcccacagcttgcctcttccctgctaactctctgatctcattcattagcagcttgccctcttttcgatattccttgaaccaccacagagtcttctgcctcaggaactttgtactcgctgttccctttgcctataatggtcttttcagacatctgtatggcctgaccctttacctcgttcaggtatttgctcaagtatcacttttctggtgaggacttaaattcacaagctcccattgttgtttgtgtatgtgtgtatatatgcattatacccacacacctgtactagattacaatgtttagaaaaatactgagcactatctatttattccagaggttccttcaatcccacttcaggtttcggtaagcctttggaagacaaccaataatcatttgtagttttaacagggggtacttacttttattctagagcacttttctctcaggctttccgtaaggtgctgttgtccatcacttagtaaccttttttcaggttttacttggtggttctgtcggtcctgctttggtaaaaagaaaataaacagggcttttgtcatgactatattcacatataatgtctaatcgcacacttctaaattacatgacatttcaataatggaattaaatattatacttgtcactcaaaagcaatgttaaaatgatcagaaaatgaataatagtatcagtaagttttatagggagtgaccttaactcattggtaaaaaagtagaaaaatcatctaatttttggagacaggatttgtttttcatagctacaaattaggttttagggccaggcatggtagctcacgcctgtaatcctagcactttaggagatcgaggcaggaggatcacttgagctcaggagctcaaaaccagcctcagcaacatagtgagaccctgtctctataaaaataaataaataaataaataaacaaccaggaaaacaaataaattagattttaatttctgattcctactcttccaaatctctgcattattcacttgtagttttaacagtggcacttgcttttatcctaatgcactttattggcgccaaccaaatatactggcaaaaccacctgtactgtctatggtgtttcaaaccctagtcatatattcttcccagcaccttggaaaagttcatatcctgtgtacattttgcatttctgattaaaaagtataaagtgaaacaaaaacattttctcccacttatcttgttcactacagtacctagaagaatatttgatgaatgaattaaatctctctataaatttagttcaggcccacataaagaaatatgagaataaaaaagatttttacagattttaataaacttgtctgaactctgttactttcaaaaagaggatttaattagatattttaagatatatgattctgaatatctataaatagtcataccagaggaacttaatttttatatttatcttcccttttttccttttaacttcaccaataagagcccaactctagaactccagcatgtataggtagagaaatgggaatatttgctctcttacaaatctaatccttcaaatatttctccatttagaataatgctatctcttgattaaaaaaaactttaaaatgttatattaagggaaatagactgctttaacacagtttataaaaataaagaattaaatgttattttctgaaaatatttttgcttcttttaaaactgttttctattgtgtaaaaattagagtaaccatttcccactgtcctttactgttcataggaatttccagagaaagaaataaaaacattgtaattcttttcaaaaaagcttaattcttattaatagttactacacaaaggaagactctgaactcactctagctatcatttcccttaaggttgctatgaattggtccctttccattttgagagattcttttatcctccttagctcatctctttctttagctacaattcttatttcttcaaggctttcatgaagtttcttagtcaactggaagttatccattctcacactttgcatagataagttttgggcctcaaattgcttcttcaactgttccatttcattaatttttttatgactcatattgacatcttctttcactctaagcagttgaagttcttttttctgaagttcttggatcttgagataattgtaaaacaagttagaatgtaagcagtttcttcaaggaaggcaaatagtgtctacttgtgttctatatgcacatatctatctacatatctgtatctatatctttttaattccacaaataattttgggcacagttacttccaaaagaagaacaaaacaacacatacctttttctgtaattcatcttttgatttatctaaatccttttgaatgtctgaaatttgaattgtcttttctgaaattttttctctaagtttatcaacagtttctttgtgttcttttgatagcatacgagcagtttttagttcctgttgtatttccagatcctttatggttagaagaaatcaagaaatgtaatgatataaaggcacgttacctttacttaatgattgagtttaaacaaaatcttaaaaattatacactcacagttaaaaacaaccattatacaacctcctaaattagaagagtaaagtaaaattttctgctggtagcctcacccatagccttctcctttcataccacttggacatctttctaaatcaatatcacaaaaagaataccccattcttatgcttagttttccattatacagatagtgccttattattggtggacacttagattatttctaggttttagtcaccagacacaacgctgcagtgaacactgtatttttgcccaaatatgtgaatataatggtagggtaaagagagaacacaactcactctagctttggtttcttgcaggctttccttgagttggtctctctccagtttgagtgtctcctctactcttcttagattatctctttctttcattacagatttcatttcttcaaggttttcatgaagtttctgagccaaatttaaattctctatttctaatttactcagagttaagctttggtcttttatttgtttctttagttgctccatttcagacacttttttctgtgtctcattgacatctttttttaacgtaataagttgatgttcatttgccttaagttcttgaatcttaagataatcataaaataatatgttaggtggctttttagggacagataaataatagtttctaaattgattaagacaactgtctacccatgttactctcactgatatcctgcacaattccacacagaattttactttcttttgaggtataatatatataaagcatgctcatcttcaatgtataacttaattattcttgacacaggtgtaaatctatgaaactacaacccagattaaaacagagaatatttctagcacttcataaagtttctgtgtgctccttcctagagacagccactattctgacctttatcatcctggttcagttttgcctgcttttgaacctatatatcacaatgtatgtatccattttcctgctgatagacatttgagttttcagttttttgttattttgaataaggctgctataaacattcttgtgtctttttatagaagtatgtacgtactcttttctcttatgtacatacccaagaagtggaaatgttgggcctcaggcaggctacatccagcattagtaaatactgccaaggtgttttccagtgtggttgaaccattttatatccccaacaattttaggcacaaacaaattagatatccaatcaaacaatccccccataaaaataccttttcttgtaatttagcatttgaattttctaaatctttttgcatatttgatagtttatctgtcttctcagaaacaattcctctgagtttgtcaatagtttcctgctgctctttcagatgcatgtgagcaattcttagttcctcttgtattttcagatcctttaccattagagaaattttaaaaacagtgacatatcttaatattagtttttaaaaaataaagtgatatattttcttagtaaaaataataacactgttactctatatctttgctgttgtttttaaggtacaggctttctcttccctgtcctcctctcttcacactctacttctgctttccagaggcaaacacattacacatatattactttttttaagtgttgcatagtatttcgatatattgttcatatttactgtttccttctgaggaacatttagattgtttcagatttttaattaaaatcactacaataaataacctgtggcatatgtatacgttgtgtttgtatatacacacacactcctttaacagtatatatgtaggctaaagtccgtaaggaaaatgataattgcagacttgaacttttcaagaacagtaccaaattatctgcttaaaaggctgtatcatttcattcttgccaacagtagtacttggttcaaagaagggttcattgctgtaagaacacaatacattgaattgccagggagaggaatgagcttactttagcttctatttctctaaggccttccctaagttggtcttgctccattttaaagatttcctctactcctcttaggccatcattttccttagtaacaaatcttacatcctgaaggttttcatgaagcttctgagtcaatcttaatttctgcgtttctacactttccagagttacattccaggcctctaactgcttctttaactgacctgtttgatacatagtttccctaagatcattttttactttaagaagttgaggctgggcctggcggctcatgcctgtaatcccagcactttgggaggccgaggcgggtggatcatgaggtcaggagatcgagaccaccctggtcaacacggtgaaacctcctctctactaaaaatacaaaaattagctgggtgtgatgacatgcatctgtaatcctagttacttgggagacttgaggcaggagaatcgcttgaacccgggaggcagacattgcagtgagccgagatcatgccgttgcactccaggcgacagagcgagactctgtctcaaaaaaaaaaaaaaaaaaaaaaaagaagttgatgttctttctcctgaagttcttggatcttgagataatcatacaataagttaggattatcagtagatataaaaagatcaatgatagtttctaaattgagtaggcaagtaagtcttcacttgccttcaattttagggtaattcatatcttgtttcattacacaaaaagtttgattcaaactctcagtaactgagataacttaaaaataaaatacctgtgcttttaaggcatcatttgagtgttctaagtccttttgcatatttgatatttcatttgttttctctgaaacaatccctcttagtttatcaatagtttcttggtgctccttcagatgcatgtgaacaatttttagctcctcttgtttttctaggtcctttatcaatagaaaaataaaaataatacattgagagtagtaccatccacatgctatagaaaggtatagggcaggaggtaaaaatcttccaccctcttctgaggcctcctagttctcaccctctaagctacttttagatgtcaatacattctagatacactattcctgaacttaccctgttccctaacaggacacttcacccttcaaatcagcactatagctctaccacattttttatttgtggcatagaattccatgacgtgaatgtgctgcacttatttaaccagtcccttaccaatggatggttagaattttccctgtttttgtttgtgttatttcattattgcaacttgttgcaaagaatatcctacaaatatctttatacagttgtgcaaatgtgtggaggatagttacaactggacttgtggatcaacgaataaacctttggaaaaatttggaaggtatttccaaatataccctcaccaactttcctcaatattggaccaattttatcttattttattattttttattttattttactttttgagatggagtcttgctctgtcgcccaggctggagtgcagtggtgcgatcttggctcactgcaacctccgcctcctgggttcacgccattctcctgtctcagcctcccaagtagctgggactacaggcgcccaccaccacgcctgcctaattttttatgtttttagtagagatggcgtttcaccatgttagccaggatggtcttgatctcctgacctcgtgatctgcccgccctggcctcccaaagtgctgggattaccggctcgagccaccgcgcccggcctggaccaattttatactcccaccaaccctatggcagatttttctcttaggactcaatgtcatagttactagaggtgtagagagatggtaactcactctagttatagtttctctaaggttttccttgagctggtctctctctactttgagagtctcctccacactcctaaggtcatctctttcttttgttacagatctcatttcttcaaggttttcatgtagtatctgagtcaaccttatattctccgtttctatgttttccaggtttaacttctgggtctcaaattgctccttcaagtgttctatttcacacattttctcctgagtctcattgacagctgtcatcttaagaaactgatattctttttcttgagattctttcatctgagaaaattataaagtaagttacaacataggcagaatttttttaggaaaaggaagaactgttcctaaaataaggcaatcatttttacattgtaatctaatgtatgtagtactttctttcataagggatatgagtaacaataattagatgtcattttccaatttaacaagtcccactttttcctgtaattcaccatcagaatttcctaaatcccaatgaatatttgctacttgagctgtcttctctgaaatattctgtctactaacagtttactggtactcagttgaatataagcagtttttgattcctcttttatttccggtccctttatgattagaggaaaattaataaaacttaacatgaacaccgtcattatcaccttaacactatttctgtatccaaaaaaaaaaaaaataagatgggaacttactttagctacaatttctttagtgttttctttcagttggtctctctctatctgaagggcctcctgtactcttttcatttcctctttttccttaatcataatttgtatttcttcttgactttcttgaagtctgttggtcaactcgagcatcttactttctatactttgtagtgctgaatccttggctttgcgatgctccttgaattgtttcagttcattcactttttcctgaacctcactaatttgttttatattaaattgttcctctttctcataaatctcttggatcttaaacataattataaaataagttaatagtcataaaaatatgtaaacacacacacacacatacacaacttaagaggaaaaggttgcttcccaaaacaattaagcatgccaaatagtagtcttcataattcagttagctactccaaacccacccatttcctcccactgtttcttcatccccaatttaccttgttctgtaatttatcattgattgcttctaactgcttttgaatggttgatatttcagtttccttctctgaaagattcactcttaactcattaatagtttcctcttgttctttcaggcaacaatgagcaactttaagttcctcttcagtttccaggtgctttattattagaggaaattccaataaatttatagaaacattataactattttgttgtaattaactcccctttccaaatatttagggtttataataatatttggttacaaaatattttttaaaaacatggtgaaagatgaaacctactttagctacaatttcttttatgttttctttgagctggtcactttcagattgaagaacttcttgcagcctctgtaggtcatctttctccttagctacagatttcatttcatcatgactttcttgaagtcttttggacaatccgagcatttctatttctatccttagtagtgctgaatctttgggtttgaattgctccatctcactcacgattttggtagtttcattgtctttttctttcatatttaaggactgttcttgtttgctttgagactcctggatcttaagagaatcataaaacagtacagttgatatccagagatattgtgttttaggggaaaataaatcaggatgctttctaaaacaattaaggcaggattcagtgcctcatttacagagcaatctctccattctcccactcttccattattcaggcatttaatgctttttaaaaattgaggtctcactgtgttgtcagcatcttattcgaggctggagacaaaatgatgagacttacaggatctctctctttttgagacttatacttcaaggacaaagatagatatgatgttgaatcttaccaaatagagatgctggcttctcctacggcccaagtgtcaaatataatctattgtgaatgataggaagggattcctagaggagaaagctttaactgagatctgaaggataagagcattagttaggcaaaaaggagtatggaggtactgcaggtagagagacctgagaatctgaaagccatgagctgcggaagagagttgctggagaacaaagaataggaagaagaatgaattgaaataagaccggcaagatctgcacctagggcctcataggccacataaaggatcctggtctttatttaaaaagtagcaataagatattaaaagaatgtaagaaaggataacttaggcttagtatagaaactggattagagaagtctaagaatgagtgtgggaagaccagttaggagactactgcagatagccagggaaagaaatgatgttgacttggattagggtggtggcagtgtggagagaaaagcaggatgacttttaaaatacacactcaaatcaataagatttggtgactggattacagaataagcagagaaggaggcatattagtagggatagctcccagatttctgactaaaacaatgagaaagcacagtagtgctttatgaaacattaaaggaacaggtttaaaaaagaaaataaaacaatctcatatttggtttcaccctttcttgtaatttagaattattttttctaaattattttttgaatatttaagaaaacagttcttttctctgaaacatcttctctctgtttcaataccttcttggtattcaagagcaatttttaattgttctgtttctagtcatttcatgattaagagacattaaaaaaactggtaacataattataatacaaacattataactataacacaaacacaagccttgattcttataagacacttgttaaaatgggaggaaaatacgaaacttactttagccaaagtttctctaatatgttctttcagctggtcatgtttaacttcaagggcttcttttatcgttttaaggttgtctctttccttggttagagattttatctcttcctgactttcttgaaatttttcattcaacctgagcctttccatttctattcttgccagtgttgttgagtccttggttgtggactgttctgttaataactccagttcattcattgtttcctgagtctcactgacttctttcacattaggcagtaactcttgttcctcatgaagcactgggatcttaggacattcataaaataccaaggttactatcaggagattatgatcataatttttttttttttgagacggcatctcactctgttgcccaggtgggagtgcagtggcgcaatctcagttcactgcaacttctgcctcctgggttcaagagattctcctgtctcagtctcctgagtagctgggattacaggtgtgtgctaccatgcctggctaatttttgtatttttagtagagacggggtttcaccatgttggccaggctggtctcaaactcctgacctcaggtgatctgcctgccttggcctcccaaagtgctgggattacaggtgtgagccaccgcatcccactggccattatcataaatttttaaagggaaaagatcaggatacttttcacagcaaggaaagtcatcttgaaccctcaggcctaccttggatcacaaactgctcattattcattttccctcaattcctgctaaagctattcatgacttttctgggtcacattctgtcatacttttctttctttgtagcttagacccaaagtgaaccaattatactttgctagcagtctgtttcatacttatttctccactagtttccaagctataagagaaaaaccatagctgagcaaactatatcccaataaatgtatgatctccattttcagatgggctccaatgctatgtctcaatttttctatgtgtatagattgatttctctttccatgataaattagtggtaccatgtaattttgcgtatttctgcatttaccatattggaattaagggattttctttctagtttataatggggggaaagaacaatgtcttatttatatctacagtctcaatgtctggcatggagtaggcttttaatacaggttggcccagtaatcccaatgtttcactttctccatagcatttaccactatttaatgttttcttgttcatttgattgcttatttatcagctactttctttcactacaaatggatcagagggattttaggggttttgtccaccttgttctcattgcatttctataacctaggagtgtgcctgccacattaaacactcgacaaatacttacccagtcaattaatgaaccacatcctagctacttcttactgcttatctttccttcaaaggagaaaggaaggaagaagtgacaaaggatgaaaggaataaaagacatacctcttcttgtaatttggtatgggatttttctaagtcctgagtatttattatttgagctgtcttctcagatacgcttcttcttagttcatcaatagtttcttggtgttcttttaggtgaatatgagcaatttttagttcttctttggtttgtaggcccttggcgagtgaaatttaaagaatattgtaatattcttccaacattgctcccctctttccaagtggctcagattttaaaagaaacacttaatagatgaaggaaaagggtataacttactgtagcttcaatttctcttatatatcctctaaggtggtctctctctgtttcaaatgacttctgtaattcctttagaacttttctttctttggttatagatttcacttcctcataattttcattaagtttctgagccaactcaagcctctctgtttccatatgttccaatgtcaattctttgttctttaattcattctttaaattctctatttcattaatctttttctgcatctcactcatctcttcttgtacattaagaagttgttgctgtttttcttggagttgctggctcttaaaatgcacaatttttataattaccattttacttatattctcaaaattcttacacaaaatcattaacagccttgcctcctatcagcatataaataggtaagtagcattaaaagtaaatgaaactcacaggcataaatgtctgcagtggtttgaatattgtcccacccaaaattcatgtctcccaggaacctcagaatgtgaacttatttggaaatagagtctttgcagatgtaattggattaggattgagacgtgatcctactggagtaggtcttcattccaatgagtgtatttataagagacataaaagcacatagagaggcacagagaaggaggtcatgtgaagcagttacaagccaaggaatgcgaagggtagctgggagacactggaagctaggaagaagtaaggaatgattcttccttagagccttcagagggaatatggtattgctgacacttaaatttggacttctaggactcagaactgtgacagaatatgtctctattgtaagccatcaagtttacagcaatttgctatggcagccctaggaaactgatacaggctgattaaggagataaactgattaaggagataaggggaagatgagataaagtaaaaaagcaaagagactaattaaatatacaaatacagctaccaaataactataattcctcatcctcttaaaaaacttttggagaatttattttcacttccaataagatgcttatgggtggctcccccaaatactgagacattaaccttcacaggctattgattttaccttttttataggagtatgaaatagacataaggttttagtaaactcaattaggtgagatagtgaaagggatcagaattaaaagaaaacacatattaagaaaaaaacaggctgggcatgatggctcacacctgtaatcctagcactttggaaggctgaggcaggaagactgcttgagcccaggagtttgagaccagcctgggcaacacagtgagacctcgtttctaccaaaaatacaacaattagctgggtgttgtggcacagctaatttagtctcagctactcgggaggctgaagtgggaggacagcctgaacccagggggggttgaggctacagtgagctgtgatcatgccactgcactccagcctgggtgacagagtgagaccctgtctcaaaaaaaaaaggaggaaagaaaaaagaaaaaatattccacagaataataacagaaccgtactatattatctattatgcaagtggcactgcccttagcttatatagaaagatctctatgggtgcattttagaatctcttgggaactacagctgttacaggggtcttagctcttacacaaatatcccaataacacctaacttctatataagaaatgattcaggaaactgcaaacatctaagagatggtaatagtgataaatcttacatttcaaaatgactaatgcatctctgcaaggaaagaatctttgttttgttgactaatatatctcaagtgcccaaaacagtgcgtggcccatgacagtgctcaataaatatttgatgaatgaatacatcatatgatttgtttaaatgatacaaagccctctctcacctaaagactctggaataatataatcctcataaggtatgttagtttagatctcagtgtaagttaaaattgtccaaaatactagcattgaaatatgttcatttgggaggtatgtgctatttctggatttaggtctacagaaataaaaattaccaaaaaaaaagtttagttagaaaaaatggccagggaaataactttaaaaattcaccttttcctttagtttttcttcaacttctgccagtctgtcacaggtcctagaaagctctccttctttctttatggcatggttcttttcttgtgcaactatctcttgttgctttttaagttcatccccaagaagtcttaattcttcctggttttcaatggtctagaaagaaaaaaaaagttgagattaaagtaaatattagctaacatttatgaaatcaggtaaaacatcagcatttctctcagtctgcaaatgaagaaatcagggaaaactatataggaaaagacaaatttcaaaaaagaaagtccttattttaataatataagatgccaagaatctgctttttatactgtttctttactgctcaatttacattcctaccatgagaattagaattgcatttaacattctatcatgagagcttagcttatttctacctttaagtcaaaagagactttttctgagctatcactgagtaataatgagactacagctatagttttttcaaacactgggatggctttggttttagcacagatcactgccagcgagctcaaaatggcagccaccctctgctagcatgacttgggctgatcctggttattaggctcacacagtgacattctcacgtatcaagaccacaaaaacataacaagccagagactgagaagaaaataccattgtttgtttgtgtgcttatttacattctgctcttttgatgaaggagacaatccccaaaacttataaaattaaaacaatacaaatggtcgcattctactatgatccacagtgaacttctccaaatatttatttaaacttatacacattgtatcacccctaaacatagaaaacctaagtgtgaaaatattggcagacatcaacaacaaacaattaaaaataaaatttaaaaattatgacagcaaaaaaaaagagaaacatttaggaacaaatttaataaaatattaaaagacctatacactgaaaatctacaacatacctctttgagaacagacaaattacagaagaagatatacaatggtctagaagcataagaaaaaatgttcaacatcttagtcattagggaaaggcaaattaaaacaacagtctgcacacccattagaatggctaaaattaaaagcaccaataaatatgaagtgttggtgaagaaggatgtttgagccaccagaattctcttaatttgctaatgggaatgtaaaatgatataattactttggaaatcagtctagcaaattctcatcaagttaaacatattcttccctgtgacacagcaattccatttagatatttaccttaagtaaataaagctatgtaaataaaaagagttgtacgagaatgtttacagcagttttattcaaaatagccaaatactgaacggaacccaaatttccatcaataggaaaaagaataaaaaaattatggcgtattaatacaatgaactattccttggcagtaaaagggagtgtagaaagtcaaacataagagactacatactgtatgattctatttgtataaagctctagaagagacaaatgatttaaggtgaacatatcaggactgataatctggcggggaggaggtgatgagggtctgtgatagaggtgtgaggaaactttctgggggtgatggaaacatcttctatcttgactggggtgaagaggaaatgggtagagacatttgttaaaagtcgtcagaccatacacttccaccagatacatttattgtatataaattatacctcaataaagttgataaaaatctgaaacaaatgaagacaaaaaggtaatgccaagtatacagtgctaaatcctaccatttcaatattttcctttaggtcagtcttcaattgttccttttctgctataacactctctaacatttgttggagttcatttttctcctgtattaaagaaaatatcttcctttgttgctcaattatctcattatccttaacatctgcagttagtgtttgggtatttttagcttccaaatcctgttttttatctatgccaaccatctaaaacataaacacattacagaagaatttcttaagtagttaacaacaactttaaaaaataataaaaatagccaacacatctattatgtgccaggtactattctcatatcttaacacatttaatcttgacagtaactttatgaggtaggtattaccataatcttcatttgacagatgaggaaactgaactggagagaggtaaagtcacttgcccaaggtcactcagaggtttagctaggttttgaatccaagtgatctggctccaaagtttgtgctcttacgtctgttcactaatcagaacaatatggacaactacaaatattaataattgtcttcacgtatgataggttaacatgattctgcatgtttacttatttcaatgacattaatacattaattaaaggatatctgcctttagtttgtacacatcttccataaatattttccaagtttcattctagtagtagtttgtttatttactactaaacgagtaagcaatcttgaactctatcactttatctatttcctcctaaaagctgggaatcattccctgtctcccactccctgcaaatctttattttcagaggcagtcctacttacaaaaggctggagttttattatatgtagggggataaataattttgataaagatctatttcataagggtgaaattcatcttttcttaatatatgtatattttatatactgcttaagaaaaatgttatataaattcatttattcataaataagtcacgaccaaatgtaacctaatacgtgaacttattggtaaagggagacagagactgaaattactattgctggtacaaatttagggtattattgtatgacattacactagttcagcaaacagctccatattgcctacacaggtatttaaaagtttttataataatctataatcacattagaaaacaatagaaaaataaaggataaaaatcatccactgtcaccaacttcacacaacaaactattagaattctggtaaatttacttctggagttttttccattaaaggttttttttttgtttttttgttttttaaacatagctattataatgaatttatatgtgtgattctttttagtttttatcttttccacttagatcatatgtattttcacatgttgttatgtaacctacaaataatttttagtagctgcttgattctctagagtagatataaactgtactttatttagcaacccccttattgttggcaatatgcatgagcttctagaagataacagtgatcacagagctaactacatgagaaattaaggtagggaacacgtagtcttttgggactagtctgttagatattataattcagaatctcatatctttcaaatacaaagcagattgagacaaaattttctgtaatgatagccaaggtttatttcaaatctgaactcagcctagaaggtacttcaactaccacagttatgaataaaatctaatagatctaattattaaataaaaaattattagaacctgtgaaaaaggaaaaaaattgtcctttatataagaataagcttactaatcataaaatatttttgttgagatacattaaaaatactgcatttccagaaacagacacatcaagtaggactaaaaatgagcattccaaggagattcatgatagacctgctagtgcagctctctggtgcctagatgaacaggggagcacctggaaatccccatttccactcttttattcccatggcagattccagcatgagcatgatacaagaccaaattgatctcagccttccatcccagactttaggatccctggtgaacagaatggcctcagaaaagccccagctacatccttttatcaacatggataaatgactccagcatatacttggtaacataggatcttagctgttcccagtgagtataactctactcttcccttcatcttctattgtctctataactgcattttggatttgtttaaaacagttattgattgccatatattattgtcaaaagtctactaaaaaaactttcccatcataaaagtggaagttattatttctttctttttttttagacagggtctcactctgtcgcccaagctggagtgctgcagcatgatctgggctcactgcagcctcaaccttcctgggctcaggtgatcctcctacctcagcctcctgagtggctgagactacaggtgcattgctaccatgcctggctaatttttgtatttttttgtagagacggggtttcaccatgttgcccaggccggtcttgaactcctggactcaagcaatctgcccaccttggcctctgaaagtactaggattacaggcataagccattgtgttgagggtaaatttcaaattgaggtcaaatgcctttggcctatggttattccaaattataaataagctgagaacataagatacagaaaaagtgagagagaagaactaaagcataaggagatggaaataaaaaaaaagttccattttccaaggcagtattttgccccggagtaaatgggggaaaatgcagctcattttatagaagtaatatataaatgtacagatatttatttatatcaattggatcttactgaattactttgaaatgtgtatttgcttttatttaataatgtattctgttaaaaatgcatgactgtacaaacatcagtagcatttctgtacactaacaatgaacgatccaaagaagaaattaagacaattttatgtataatagcatcaaaaaagaacaaaatactaagaataaacttaaccaaggaggtgaaagacatctgctgaaaactgtaaatgttgctgagaagaaattaaagaagacacaaatggtaagacatcccatgttcatggattagaagacaatatttttaagacatcaatactaccgaacaatctaccatttaatgtaatccctatcaaaatcccaatggtgtcttttgcagaattagaaaaatctatcctaagattaatatagaaccttaaagggccccaaatagggaaacgaatcttgaaaaagaagaacgaagttggaggtcttgtacttcctgatttcaaaacttataaagctacagtaatcaaaacaatgtggtgctagcataaagacagacatataaaccattggaacagaatagaaagaccagaaattaatgcttgtgtatatggtcacagtatcttcaacaaggatgccaagactactcaatggggacaggatgatcttttcaaaaaatggtgttgggaaaacaatagccacacacaaaagaacgaagttgtaccctgaccttacactatatatacaaataaatgcaaaatggattacaggcctaaacgtaagagtgaaaattacaaaactcttagaagaaaacataggggaacagattcatgataagggtcttggcaatgatttcttggatatgacaccaaaacacaggcaacaagagtaaaaataaataaacttgactacattgaaattaaaaacttctgtgtatcaaaggatacaatcaacagagtaaaaagacagccgatggaatgggaggaaatttttgcaatattgcatataactgataaaggggtaatattcagaagtataaagaactcctacaactcaatgacaaaaatcaaacaacccagtataaaaatgggaaaagacttaaatagacatttctgcaaggaagataaacaaatggccaaaaagcacacgaagattcaacatcactaatcattaggaaaatgcaactcaaaaccacgatgagatactgcctcacatccattaggatggctactatcaaaaaaaaaaaaaaaaaaaaacagaaaatagtgtgttggcaaaggtgcatataaaccagaacacttctgtcctgttggtgggaagtaaaatggtgcagctgttatggaaaacattatggtgctttctcaaaaaattaaaaatagaattaccatataacctagcaattccacttctggatatatatatccaaaataactgaaagcagggttttgaagagatatttgttcactcacattcataggagctttattcacaacagccaataatgggtagaagcaacgcaagtgtccatgatggatgcatagataagcaaactgtggcatatacatataatggaaatttactcataaaaaggaaggaaattctaacacatgctacaacatggatgaagacattatgcaaaatgagacaggtcagtcacaaaagataaatactgcatgattccacttatatgaggtactcagagtagtcaaattcataaagacagaaaaataaatggtggtagccagggtctgtgggaaggaaaactggggagctgttgctcaatgggtatagttttggttttgcaagatgaaaagaattctggaaattggttgtatcacaatgtgaatgaattttacactagtgaagtatatacttaaaatggttaaggtggtaaattttatgttatgtgtattttactaccaatttaaaaaatatatactactatatactattccaagctatatatttacaaaagattatttcaccagtctcctattgaatattttaaaattctagcagtaaatactctggataaaataatatgaactataataaaaatgagacatgttattacaaaattactgttaccaatatatcttagaggtgttgtgggaaagtagaaaagaatactgttaataaatgaaaccctggtataacgttataaggcaatcccctctgcaatggactgaattttaaactctaagcaagtttagtatagtaaatttgacataaaataagtatcagctatgcaaaatttggactaatacatttttgggccctttccctttctaattgattataaacatattctatcataagttatttcaaaggcattagggataagcttgtaaaattattgttagttattaccattgtgagtaacaaatgaaattgagaatattatgcatttaagtatttgaggttaaagagtatatatacaagcatatgaaaactctgaaaataaacaccctttaccttttgctgaaattcatctttagtttctcctgtattttcctccatatgcaaattcctggaaacttcctcagaaattttcgattttagtgtattaattgtttcttgatgttgtttcagagactcaagagcatttcgtaattgttcttgagtatctatattctttgttagaaaaatataaaaacaatttccattagaatatgaaacaaaattattttgtagctactacataacataatcataaataataaatgatggcctctgcaatgtttttaagagtctccaatttttcaaagtttaatcaatcaaaaccttaccatgttaacagtatcgtgaatatcacttttgagttggtccctctcaatttgcaagctttcttggagttgttttagatcatctttttcttgagttaaagtttttacttcttctaaagtttgctgcagtttctcagtaatcagtgttttctccctttctacagtttgcagcgtagaatctctattttctaattgttccttcagctgttccatctcatttagtctttcttgaacctcacgtgttttctcctgaagttcttgggtcttgtaagaaagctttaaaaaagaaaaagtaaatgtcacacagtaaaagcagagcagtctgaggcatacatatatacagaaaccaaaaccccagaagactaaggagcatttctcaaaatagcatcttgtaccaacctcggtcttcaaagcacccaaactcgaatcaaatttttgggcttctttagagagattaactatttcctgattcattctctcattctcctcaaggaccatcttatacttttgctcaaagtccatatgaagggttttgaaattttggaattcttgatcagtgcttttataattcgactgtgtagttgctaggtcatcttttgttttcccaatttcttcaagtaaaccttgaactctactctccttatgaactacttcagaaaacaatttatctttttctgatgttattatatggagctcttcagatttgtcttgtatctatggaaaagaaataaaatttagggatgttagcaacatatgattcactgaagcaatttttaggaaaaaaagctttctctgcaaaaagagaagttatttacattcagcaaaaatttgactgtggaaaggcaatatagtagtactcttattgtcacttttccctaactcagcttgtttaactctacctttgatgttttattttctaatctctttgtattctagaaagtaaggtctgcatggaaaatagtaaaggcacataatcagattgtctttatttccttacctatcattttaaagtgttttctaactttatcatgtggcaggcatttctcagaatttgacatttttttccctaaaggctttgaatgcctctcaggtttccaaaaacttaatcaatgaataatttaagtaatgtttaatcatttaaaattgttatttaagaagtatcttaagtggtatggtccatgaaaaaaataaaaatagaagtaccacttaagtaatatttaaataattacataatttaaataacccatatcttgtatattaacagtttaatcactgtgaaagataagggcagagagagatgagaaaaaaagaagagataaaggagggacaaagtaaagacgggcaatacagcgtgtagctacaatcacgggtttaggaggcagatttatgtggctcaattatgagtttgataatgggttattgggactaaaaaactacctatttttgaagagtttataagacgagtaaatgaaataatgtttttgaagttctttagcatgatgtttgccatacagtaagtactcaaatttttgccatttttcttttagacaagtagaaagaaaaactggcaggccatggatttacagaaacattcaccagcctgcaaggtttgcattaacctctaaaactttatcagtgcaacctcttttccctcattactgtcttttattcaacataatgatactactactaccaaaaaaaatggtaaagactaagggtgggccgtaatactgtataaatgcaacatttgaggactacagaaatggctgctacatggattatattactaagtattctgttaaatacaccttgaaaaaatatattttttaatctagtagcataagaacaaattagaagatgaactatattcatttctatttctaactagtcaaaacgtttacagtatctctcttgtctgctagtttaaaataaactataccaaaatatttaaggcactattatcgcaaaggtttttatttcaaaataagggataagtgcttataaatgtgtttacctctttcctcagcctttctacttcagaaggtaaagatttcaattctgaaagcaaaatgacttcttcccgcaaagcttcattttcttcaacttctttatttagttctttctgaagatcagtaatctttccttccaattccaaattacagagcaaatctagaaagttttggtaaattgtataaagatccaatgttgccaaacaggtaatttaatttttaattgtccttgaatcacctttttcaggatcaggtaaagtttatttgaaaaataatcccttatgatttgaaacccatggaaatctttataaatattaataccaaatgaaactaaaacgtaatattgagtttttaaaaagtcagagtataatgaatttttaatcattgaaatatgcttgtcaaattgtttaggtacatttctagaagaagtcagatttgaaaaaagatgtttaaaattacaaaataccttttggaactttgccatctataagggaggtgagttttgttatctcattaaaagcagattgtaattctttctccagatcaacttgcattttcttttttgcctccaactggctttgatataactgaatatcattttccatttgcttgtatgtagttgcaagttctttctattgagaaaaacattgcaaatgcacaaaaatacactgatcattacaactactttattataaatattacaaaaaatacttaccattttctccttcagctccagattttcacttctaagaaaggctgattctctcttggcatcaagggctacagtttcagcatcaaacagagtctgcttcatttgttttgggtcttcaatgctttcctagacagatgacaaaaggggttcactgaaatctaattttcacagagttggaaaattcttaagagaacatgtatataaatgttaactctagctaatcaaaaagcgtacaaatatgctagttaccaaatatataaaaagaaataatgttttcctaataaaaataatttttaaaaattctggtcatatttttcaaattatataagcaatatatcaaattatataagcaatgtatcataatttagatctgttttgtttaaaggttaaaacaactgttgttcggcaaggctgatgaagttttctatgtatttttattttgagttattctcttcagcacatgataggtaagtggctaacagttaaattaaagatattaacccacaaattgaaaaggaaaaagacaaatgatctaatagaaaaatagagaaatgatatgaacaagaaacttacagatgagaaaatgcaaatgaaaaatacatgaaaaaaatctacaacctcatttctaaagagaagtggcattttaatatgactttagcttatatgaaatcaatgatatgtccttggaaaaaaattaataaattaatacatgaatgaataaggaaaaagaaatagtaatttttaaaaagtgggcagttctgcttgccacgctatgaacagacactccagaatacataaaagtgccttcctatccagggcctcagaataggatgatatgaaatggtatgaacccctttgaaaagaatcatttgtcacaaataaaaggcaacaaaagaatagaaggtaacaaaaactaaaaaactcaactgaaaacagaagaacagaaactagtcttttaaaagttccagctagaaactgttatcataaaaaaaaaagtattaaaaactggaaccaaacatatataagtaatcaggtatactgaaagcaaactgaagcgattaaatgacatcatcatcagattcaatgttagttaatgccaagatcttatatcaactaaaatcatctagagctataaaattgtgaaaaaatatcccagtttaatatttaagatcttgactatatactactgcatgcatttgtataaaactactgaaaaaaattcggaattttaaaattttactgatttttttttttttttggagacagagtcttgctctgttgcccaggctggagtgcaatggcatgatctcggctcatggcagcctcaacctcccaggctcaagcaatcctgccacctcagttacccaagtagctggcagtacctgccaggcttatttttgtatattttgtacagaccaggtctcactatgttgcccaggctggtcttgaactcctgggctcaagtgatctcccacttcggcctcccaaagtactggcatcacagggatgagccactgtgccctggcctaaaacttactgatttttaatgggagcctgtccttaacttccttatatttactcaaaggatgacatgatcaactttccacaaatgtgactttatctctaaaatggcaaatatactaacagtccctatctcatagggttattgacagatttaatgaaatatatataaatttattacaacaatacacagcacaaagtaggtccagtataagcatttgctaagatgatggtatgctatatatatttatgtgattacacaacaaaatacgcctgatttttaccaatgagtatgacaagtccatttttatattttctagcttttgagagtctatgtattcctgtagcttcttaatctggtcttccttttctctaagcagctctacttttgaactgagttcattctaaaagaatcaaaggagagagtaacaatttagaatctgatttgaagtctaagggattaaaacagaacttatatatattagtttaaattcatagtaaaattcaaagtcactaatattttaaaaacataattcccttatttctgacatcatgttcagttacatatgttgcatgttttatagttctaattgcttatcaatagaaataccaacatgaatgctcacctcaagatcttgattatatacttctgcatgcttaactaaattctttaagttcgaaatttcatgaattagttgcatctgtaagagcatgtgaacaggtaacagagcaaaccaatagttaataaagcaaagcaaaaaaaaaaaaaaaaagaaaaagaaaaaaaagggcactggttcactgcttcagaatcacccaacagttagaaaggactgagatcaattgttcaagctatcgcaacaaagcacctcattatttaaaaatactagaaatatcacccaaaacatatcaaacaaataaaaaaaaacccctcagcatgaccccaccaagtagctatatcatctgttaataaagctacaataatgtcaatagcaaattagtatgcactacttggaggagagatttaaaaagtggtaatcaaaccttgaaaaatacacgtttagtagatttttgttttcagtcagttaagtacagaaatgtattaattcttataaagttttttcttcccataaagtatccatcagctctacattagtgtactttttaataagttctgatttggaatctaggtttggattagggttgtttcatgcagtgcctttacaatattattacttttcaccagtgctacacaggtatggaatgatcaactatgaccttgatttattccagaggaaatattgcactccattatattgttcaaccatgtaaaagtataaaggtagaagtatttctattgaggtgtcctttctaccaaaatatctgtagcattaaatatctgagtaccaaaaagtttgttgaaaacaagtaaaccacacataaccaagataaacattttcccttagaattatttaatcttcataatcagatgagcacttacagagtaaaagcaaattctaatagtatgtaaggggcttgaaaatagtatcttatttaaatattttctggatgtttaactgagtcctgactagttttaaatttcagactagtgcaagtgttgacattactattttaggtcagtgctatccaagagaaacataatgtcagacacatatgtaatttaaaatttcctagtaggcacattaaacctaaaaagaaaaaggcagaattaactttgagaacatattttattcaacctaatatatcaaaaatatttcttccaaaatgtttcttcaggtaatctatccaacatgtttctttaggtaatcaatataaaaaaaatgaacaattttacattcttttttatatactatgtcaattcagtctggtcccatttcaagtgcttaattgccacatatggttagtggctaccccactgtagaacacagtcttagacatttgtactgcttttaatttaaattggctccttctttcaccttttcttccttatttttaacttctgtgaaagaaaatcacatttaccaataagaaagaatcaaaaatcaatcttaacttttaaaaatacttagaagagatcgggtgcattcagggtagtatggccatagataatgaaaacatttaaagaatactaatttagaaaagaaaattttcctacttcttatttgaaatagcactttatcttagtactggttcttatgcatagaaaataattagcttttataaaaataaaagtgtaatctcccaatgacatgtttaagatgcagagcatgaagtgaaagtgtgtgaaaaggaaaaatgatttaaacatatgatctgatctacagttaatccattgctaccatttaaattgcagatttaaatggtaattgtcattaggtgaaatgaaatatttaacttacatctccaagtagtaaaaattataaaattaaatacaccaagttaaaataggtagacggtaaagatttttctcattcctcgagtatggtgatacttgacattttccattctccctctaaaacatactatttaagcatctcatgttactatattcccactagaaaattatctacaacttgggtgatttttgacaaaagctttaggaaaaccagggaaatggctccatgtcctaaggccaatttgacttttattcccttttagctaaacctttccccaaaatgtaggttttggaacatattttgctacatacacatagacttatatttttagtttaacatggactagatactgcaaaactggttttgaacaggatgtttttattacataatcttttaagtaaccttaaattttgtgtcgaattaaaagtaaagggcctagagcagtggctcacacctgtaatcctagcactttgggaggccgaggcgagcagatcacttgagcccaggaatgtgagactagcctggccaacatggcaagacccccgtctctataaagaaaaagttttttaattatatgtcttttagattagaaagctgagctttgtgttttaaaaaaaaaaaaaagaaaaaaaagaaaaagaaatttaaaaagaacggagtaggattcttcctcctcaactgtggttaaaatgggagaaaaactgcagtgtgatacatgtcatatattctgtggtatttttgtaatctttctctgtgttgactcaattcaataagcttcaatttttcttattaatatattaatgatgtgagaaaaatattagagaaattattaccacttatcccaaacgttagttttatgtcatgttattatcacatataaaaaacatacaaaaattagatgaaattttaaagtcagaagggaccttggtgagcatctggtctctacttcaagggtggagaaatacaggaagccctgagattcagtgacttgcccaaggccttggcaacaattcataataggattggatctgcggtaagtttataagtggcaaaactgcggcttaaatccaggcaatttcactctagagaccatgttcttaatcatgacactaggccagtcccttccataaaacctagttttattgattaaagtccaatggttttgtcatgcatgacattttgcacttcattaacatgcattttaaaacaagctaaatgaaaccctgtggagaacttatagacttttacctctttgaatatagtacctatgaaataaagcaataattttaatttgtaggtagaatggaaataatagctttggcatagaattcttttttcctttaaaaatgaaaagaggttgagaaactgaacaatgatatcgaggaaaaagggtcatggccttttgggctagccacatagaagtctgaagagtagctgcaaattaattcatcttttaactacataaaacactgggtcttatttttttttgaaggggggatgttcacgaatcactttgcaagtctgataacaactacagattcttgttccagaaaaatgaatatgcattgaaaaattctgcaaaataatttcacagcatctgtggcctctaggttaaggacactttacactaataactccctttaatcttttggacaatttctgagtccctaaagtctgatggtttctggattaagttctcttaacgtgtagcctaatattttatacttagaaaatgagtgatctgtttctataaattccattataactatttagtattagttatactaattttcacataactctcttagatggagaaggaaaaacaaaacgtacaaaattagcttctccagctattctaatgttttaattatttagaaacatactttctaaagaaaaagaaatccattaatatgtagcatccatatataaaatagtcatctagatattaaaattcatactgatctcagtaggaaactgctgtgctctaggtagcatttatatatgctcaataaaatgtaatatacaaactataaggaaacaatttcaagacaaatccatcaagaggtagatacaccaacccttcccatagatgcttttaattcctttttctcttgcataagcaccagggaaagaaacatgatttaactatttttaaaatataaatgaagaaaatatttcttaaattttctaaattgtatatacatatgaaaaatggttagatcttcaacatctcaatcttagaaaaaaaaatctttaagacaatacttctgagtgatgtcaagaagatgacagaataggaggtcacctgctcacatccccccaaaacaacaagaattctgtacctattacagacaagtctttttgtgggagcctttggattcaggtaggaggttgtaaaaccccagtagaactcaagacctggaagtgttgtttttgagagtgcataccaacacccaggtgggagtcctgccaattgtgctcccaggttcatatgcagaaatggtcccattccttgaaggacttagctacagccctgtttggcctagagtctgcaaccaaaactatctgtcaaggggtccaggagaaatcacacactctagggtctcggcagatgggctcttctgcctgtcgacattggtcttggcagtggacccaaaagttagcctataacttggctcctgccctcctcaagctgtagtcctagcttagtactgcttgcacaaggacccagaagggaacatgcccatctgagccaccaggacaggcttgccggcctctgtctcatagcagattccgacggggacatgtactggctccagccctcccctgctgcagcctccctgctctcacccacacagagaactgccaagagatgaacctgtctgagccactgggtcaggcttgcagtcctccatcccacaatagactgaaggggccctgtctcagcttcaatgcctctttgctgcagtcaggaagctatctcgactgtattgggaactgctgggtgaagcacctgccccagccaccaggacaggtttcatgcatctttcccataatagatcctaaagcagtcttgtcttgactgcagcccctctctactgcagcctggcagttatcctgcctgtgtaggacaggcctgctggcttccatcacatagcagttctggaaagaaccttgaatgtcacagctacagaatgcaagcaatcctccctgcataaggaactgctgggagtcttgactgctggtgccaccaggttaagcttaccaacattggttccatagcacattctgaattaactctgaagcttggtttcagtttctcctagcgatagtctgagaatggttttacccagccggggtcctaccgggagacaggcgtatccaagtccctgtggcaggttttgcaacccttgtccatcagcagattctcaaatggccctggatcttgatactgacccctctcatctgtggaataagaacagctctgcccacctggggacctaaagagaaaggtgtccagtagtgcctctgcaggataacatggtgacctcagtcatactatagatcttgaaaagaccttataaagatggtgaagactaaaacaaatagctacattcatcttcaatgtgcagacactgctgcatgaccacaagcatcatgatcagggaaacatgatgtcaccaaaagcacaaagtaagatactggtgactgatcctaaaagatggagatgtattatctgccaaagaattcaaaatagctattttaagcgagctcagcaaacctcaagaaaacatagagaaacaatccagaaatttatcaaggagactgaaataataaaaaaaccaaacagaaatcctagagcaagaaaatacaatgaacaaaatgaaaaatgcaacaaagaacatcaatagaagaatggatcatgcagaagaatttgtgagcttgagacaggctattttaaaatatagagtcaggaggcaaaaaaaaaaaaggatgaaaaggaatgaagtttatgggacaacatcaaaaaagcaaatatttgggtcactgcagttcaagtagagaaaaataaagggacagaaagcttatttaaagaaataatagcagaaaattcccaaacctgaagaaagcaatacatatccacatataggaaggtcaaaggttaccaatcaaattcaatctaaatgaccctgccctaagatatattatattcaaactcaaaagtcaaagacaaggagaaaatcctaaaagcagcaaagcagcaagagtaaagaggcaaataacatagaagggagttccattatggttagcagtagacttctaagcagaaatctcacaggccaggatcattaaaaagtcaggaaacagatgctggagaggatgtggagaaataggaatgcttttacactgttggtaggagtgtaaattagttcaacattgtggaagacagtgtggcaattcctcaaggatctagaactagaaataacatttgactcagcaagcccattactgagtatatacccaaaggattataaatcattctactataaagacacatgcacacgtatacttattgcagcattgtttacaacagcaaagacttggaaccaacccaaatgcccctcaatgatagactggataaaggaaatgtggcacatatacaccatggaatactacgcagccataaaaaaggatgagttcatgtcctttgcagggacatggatgaagctagaaaccatcattctcagcaaactaacacaagaacagaaaaccaaacaccacatgttctcacttataagtgggagttgaacaatgagaactcatggacacagggaggggaacatcacacactggggcctgttggggattgggggcctaggggagggatggcattaggagaaatacctaatgttaaatgacgagttaatgggtgcagcacaccaacatggcacatgtatacctatgtaacaaatctgtatgttatgcacatgtaccccagaacttaaagtataattaaacaacaacaacaacaacaaagaggaatctcacaggccaggagggagtgcaatgatatagtaaaagtactgaaggaaaacagttgtaacatcaaaagttagaaaatcaaatattcagaaagtgggaggagataaagtgtggagtttgtttgtttgtttagtaatcaatgataatctgttatcagtttaaaataacctgcataactgtaagactttttcttgtaagcctgatggtaaccacgaaggaaaaaaacctataataaatacactaaaaatagaaaggtatcaaaacatactatcagagaaaataatttatccaataaggaagacagtgagataagataaaaggacctaaaaaacaaataagaaaataattagcaaaatggaagtagtaatttcctacctatcagtagttcctacctatcaatgtaaatggactgattctccaattataagatagagtggttgaatggattaaaaaatccaaatatatgctgcctgaaagagattaacttcacctgtaaggatacaaatagatggaaaggaaggggtggaaaaagatattccatgcaaactgaaattgtaagagagcaggagaagctatacttatatcagctaaaatagactttacatcaaaaactgtgaaaagagacaaggtcattacataatgataaaggggtcaactcagcaagaggttgtaacaattgtaaatatatatgcacactgaacatggcagaatatatataaagcaaatattaatctgaaggaagagagactgcaacacaataataatagaggattttgaaactacactttcagcaatggacagattattcagacagaaaatcaacaaagaaatagcagatttaaactgcagtctagaccaaagagacctaacagatgtttacagaacattccattcaacagctgcagaaaacacattcttatcaactgcacatggaacattctctaagacagatcatattaggccacaaaaacagtcttaaaaaatttaaaatcaaaattatatcaagtatcttttctgaccacaatgacataaaactagaaattaataatagcagaaattctggaaatattacaaatacataaaaattaaacacgctcctgaacaaccactgggttaatgaattaaaagagtaattttaaaaagctaagacaaatgaaaatggaaacacaatataccaaaatgtataggatgcagcaaaagcagttctaaaagagaagtttatagtaataaacatctacatcaaaaaagaggaaagaaatcaaactacctaaactattacctcgaagaattagaaaaacaagaacaaactaaaccccaaattagcaaatggaaagaataaagatcagagcagaaataaacaaaatagggactttaaaaaaatccacaaaataaagagttttttttttttgaaagaaacaaaatcaacaaacctttagctagactaggtaaaaaagacagtcgactcaaataaataaaatcagaaataaaaaaggagacattacaattgataccacagaaatacaaagaacaattatatgccaataaattgaaaaacctagaagaaatgaattcctctaccacattacctaccaggactgaattatgaataaatagaaaacctgaacaggccagtaatgagaaaggagacttgaatcagtaataaaaagtctcctatcaaagaaaggcccaggacctgatggcatcactgctgaattctaccaacagttacagaagaactaatagcaattcttctcaaagtattccaaaaaattgaagaggaaggaatttttcctaacttattctacaaggccagcattacactgataccaaaaatagacaaaaaaggaaaactataggccaatatccctgaagaacagacagaaaaaccctgaacaaaatactataaaactgaatttaacagcacatttaaaagataattcaccatgaacaagtgggatttatcccaggaatataagaatggttcatcataaacaaatcaataaacatgacataccgcattaacaaaacaatgaaaaaaagtcatacaatcacttcaacagatgcagaaaaatcatgacagagttcaatacctcttcatgataaaaactcttaattaggtatagaagtgatatgcctcaacacaataaaggccacatacaacaaacccactgctaatgtaataccaaatggggaaaagctgaaagccttttactctaagatctagaacaggataaggatgttcccttttgccacttttattcaacatagtacaggaagttctagctagagctattaggcaaaagagaaaaataaaacataataggaaaggaggaagttaaattgtctctatttgtagatgatatgatcctatatacagaaaaccctaaggactccatccaaaactgttacaactaataaaaaactcagtaaagttgcaggatacaaaatcaacataaaaaaaagtagtatctctatatgttaatggcaaactatccaaggaggtgtcagatctctcaaatgaaaactataaaacgttaatgaaagaatttgaagaagacacaaatgggaagatatgcatgttcatggattggaagaatattgttataatgtccatattgcccaaagtgatccacagatgtaatgcgatatctatcaaaacaccaaagacattcttcacaaaagtagattaaaaacaatcctcacattcgtatggaaccccaaaagaccctgtatagccaaagcaatcttgagcaaaaagagcaaatctggaggcatcataccatctgcctccaaaatatattacaaaactatagtaaccaaaataacatgctactggcatagaaacagacaacaggccaatagaacagagaacgcggaaataaatccatgcatatacagtcaactgatttttgacaaaagtgccaagaacatatgttggggaaaggatagtctttcttcaatagtggtgctgggaaaactgaatgaatatctatatgttgaagaaaaactagatctcctgtctctcatcatatacaagaatcaattcagaatgagttaaggacttaaattctaagacttgaaactatgaaactactagaaaacaagatagtggaaatgcttcataacattggtcaggacaaggaatttttgaataagaccttaaaagcacaaccaaaaagaccaaaaacaaataaacggaattacaactaaaggcaaaggaaatcatcaataaagagacaatatttgcaaaatatttgcaatatttgcagaaatatttgcaaaatatttgcaatatttgcagaaatatttgcaaaatatacatctgacacatggttaatatccaaaatatataagaaactaaaacaactcaatagcaaaaaaacccccaaacaacccaattaaaatataggcagaagacctgaacagacgtttctcaaaagaagacatacacataatatgttcaatattactaataatcaaggaaatgcaaatcaaaaccacagtgaggtattgcctcatcccaattagaatggcttatcaagaaggcagaagagaacttgttggcaaggatgtggacaaaagagaatccttttatactgttggtaggaatatatagaaaacagtatgacggttcctcaacaaagcaaaaatagaactaccataagatccagcagtcctactactgggcatgtacccaaaggaacttaaatgagtatgttcaagaaatatctgcattcccatatttactgcagcactttccacaacagccaagatatggaaccaacctaagagtctaccaacagaagaatggataaagaaaatttggtataaagtcacaatggaatattcttcagctatttaaaaaaaaaaaaagaaatcctaccatttgcaacaatatggatgaacccaaaggacattataaaccaggaacagaaagacaaatactgcatgatctcactcacatgcagaatcttaaaaagctgatctcttagaagtacaaagtataatggtggttattggaggctggggtgtttttcagggagaagaaaatggggaaatcttggtcagatgacataatgacagttagatagcaggaataaatttcaacagctctattgtacagcaaggtgactatagttaatgacaatttattgtattcttaaaaaacataaaatttgtggatactatgtgctatcaccacaaaaacaataactatgtgaggtagtacatttgttagctagatttaaccattccacaatgtatatatacttcaaaacatcatacatcatgttgtatacaataaacacataaaatgttatctgtacatttaaaaaaaattaaaaaagcttacattatagaaaaaagagaatacttcttttaaaagtatgcttttagtttagttttacatttctgtctctcttacctcttgatcttttttagtttttctttctagagcctcaaattcatccaaatcattcttttcttttaatttcaattccatttcttctttttctgttcgtagttgttcatagtctaataccagattatcatagtcagcacgaagtgagttcaactcactttctatattctcctattataaacaagaacagattttccaatcagaaaattcaaatattttttgtttccttaataaaatttgaattatttaaataactactttaactttgatttgatatctttctaaagttctacattttggcaaactagctaacttagaatagattattttgaaagaaggagaattttaaaaatatatcaataaagtgtatgtttgcctgtgcctgacagggaattttgaccataagtcctcaagctcctcagtaataaaactgataattgaattccccaatctaactaactcttattttatgtctcagatggttctgaattcaagaatggaaacagagatattatttattgacttctaaagctaatgacaactgtgttttactataaagaggcctatttctattttctatattattataagagaagagataaaccatgagttaaaaaaatacttttttacaccagagattgtaaaaaaaacccaagaaacttctaatgtatgtattaggaacaaaaaaacactttatcaataatactttataggaattaactaacaataataagtagtaatgcaattatattctaaaattcaaatgaaaatgtctattactttatacaactatacatctttaaacacgagcaatctacaaagtaaacacggaatctaaacttactgatgtattcaccaaaattacctctccctgatatattattctatacattataaatgcctgagaattgacacttttaaaatcagtcttgttaccctaatgaagtttaccaaggcaaaacagaaactttacaaacattgtgaatactaagatctgctagtaaagagctagaggcaaaggtttacctactagcacatgtctgccttatgaaatttttagccttcctctaggtgcctgatggttatagagtagaaatgtaaagagaaaagccttcattagagccaaaatcattactgaaattaaatgagaacaagtaacaaaacctaataacaaaagaattttaaaaagagtaaaagcattatatgctgtaaaatacattaagttacctgatttagtagctttgttgctggattccattctatctcacttaatgtatcaagagtgttactgaaaacatcagactctgaacagacagctataattagagaaaaaaaaaatttgtccatgaacatgtttaccaaatttcctaagtcaaattaaagattactaaaaaaattcttatcagagatactaagaacttcaaattaactactatgtgctcagagtatgaataccaaaagtacattaatagatatggtcatttatgttattgtatgaattaagatgatcactggttggaattagtgacacaatacaggatccttaatgaaatataggttaaaaggacaaattctgaatttgagatttgatcattataagtagatttaaaattcccccccaacagactgtactattgaagaaataattttgaaacagattcctatgtcaatgccactcttttaagattagcaaaggcagatgccatataactaacaatttaattgaataataattagaaaataaaaacacctgtctcatgtgtgtttcaactagtgcatcattcttaggagattcagaataaagaacttatgattactttctatttatttatttatttatatttgtttgagacagagtttcactcttgtcacccaggctggagtgcaacgggtcttggctcactgcaagctccgcctcccaggttcaagcgattctcctgcctcagcctcccaagtagccgggattacaggcgcctgcaaccacgcacagctagtttttttgtatttttagaattacttattttaaatcatagtctccattgtaatcacatatgaaatacacagtatttaaacatgtttatcacattaactgagctataaacatagtttctctttataaggatgcttttataattaaacatagttccacttgaaaaaagcactcacattcatcaatttctcgtaataaatttatagaaagcttatgtgtttttgttgttatatttgttggtatattaaattgatctgcatagtttgagttcttcattttgttaattttgccaaggcaccaagtaactcttcgttttcttttagcctaaagaagaagaaatcaaaattatgtcatatagatctgtattcaaacataataaaacaagggaactagtttctatttttgaaaaccattgacttggtagaattcttattaagcctagtttaaaattttattagtctaaggatattgcttaaaaaaaaaatcaaactcttgactctttacttcactctaactaccattttctttttttcctactttgtcctcctcatcatttatccactccttcctcaacacttcagggacccatctcctggttcttaccttacccagctgctgtccttaccactcactctgctttgctagtttctcttcctgtgcctgcctcttaagtgtgtttctccaggtttcatagccaccattcttctcttgactctttactgggtgcaagtatcatctcatcttatttgactctctcggcaaccctagggttgtaatcacatctgaaatacacaaccctaaggttgttgagagaatcaaataagatgagatgatacttgtatcgagtatcaaccttactacatctttttaacagatgagttgggtgcccaacaagtttggagaagttgcataaggttgtatagccaattggtggctgagcccattgtctattacttcagagcctatccatgcaaccattccgtcacattgcctcttaagattacttgttgtccacagaatatactgcatactgtcatgcctctctgagtgctgtccttctgcttgaaatggccagccctttccacaccctgctctgcaaaagccccatcatattcaaatcctcgactccaataaccttcagtttaatgccagttgctaccaaagccacacctggaccttgtcattatctgaaagtcataaactagacctcttgctctcattgccgttgctgtccttccaaatcattaatttagttaatcccactatagctatttagctcatcaggggctatttagctctgttcccttgttgcatgacttttttttttttttttgccatctccctcttggttctcaccctatcatcttagattccatagatcactgtaatcatgtttgaaatttgaggtcaatgttctcaaattatttgacccactctctgtcccttacatgtaccctacacggcacactcaaatggcactgtgttcaagacctttatcagcctcctgagcactgccagagccacacagccagaagaccggctgacaagataaactggacctttaatgttgcatggcaatattcccttcccccttgtcagctttctttttcattacctacaaaggctagcctatttcaaacccttagtatctctgcaaacttatgactctaccatcacctgccatctcagcagaagaattaaacctatttcacaaagaaagtataaacctaaactcctaagagtactacctgcacagaagcctatcctttcctccatgtttgctccaattcaagaggtatttctcctatgttagtccaattctttctactatattcaagattccatccatctaggccacctcaacacactataaggtggctttcatccccatcacttaaattacttttgcaaatgagctctgtgtttctaaatgcaaataatttttgtccatctttatcttatttaacttctcagcagaatatgacactgctgaccactacctccctgaaatattctctccccttagctaccatattcactaggttttattcttaactgtacagctaaacctgggctgctttatggattcttctttctctgccttacccaattggagttttgccttctgtcactttgcctcctgttgccttctctcaacatgcaaccagaacaaactttaatttggatctgtagtagttaatgcccaaattgatatttatatctcaaatcttctacctcatattcacacatttgcattttcaacagcctgacatctcaaacaaaagaaatcccaaataaaacacccaccatttccactgctctttattcagtgtgccttaactcaaccaatattgttaccagctacccatgaagccaaggaattgcttgcaagtcattccggacacctccttctccctttctctgccctcaacatccaaacaatcacaaagtcctgctaagtttaccttccaaacatttctccaatttatccaattcactccaactccagagccacaatctttgcaggcccaagcaatctgatgtgcacagtagctacatctttctcaactataattctgatgtcacacacaaggctgttctttgttgttagcaaaacatcacattcaaatccctcaaggaggtttaaaacgcccctgctactagaacatcttaagtgcaaggaatgcataatgtttcttcacaactccaagcttttgtacatgtaggtctcttttgaaacattcttctctaggtctttcattgggctacttcctgctcaccactcaaccaatagttcttgattgtcttctatatacctctgtacataatgcttattcacattaacaatgtacattagttgagaatatgctgtgtggaaagtgctgtgttgagctaattctacctattatctcatttaattctcacacaacacttatgaggtgagtatcaagctattccacactgctacttccacaggaaaaagcagcaaagtgaattcaagaaattgtccaaggccaagagtcaggaaatgacagattcaaatccaggaagtctagctccagaggtcattctcttatccatgacaccctcacaccccaaaaagtctactgaataaataaattcctactcaattaaaaacaaacaaaaaatcacaccaacaaagtaagaattttgttcactatgttgtttttctttcaccagagtctacattgacacaattatgttgttttatattctacaccaattttcctgagattaatatttctgtttaagtagaaaataatatttccacatattctagaaacctatggcttccaatcacccagtttctctagaatttattaagcagaatattgcaaataaattatttaaatacattccaaacttgttgaattagaatctctacaaataggaatcagaaattggcatttttaatgaatctcttaggtactatgaaacacaaaatcttctgggtttcttgaatatactgtatcaaaggatagaaagtgcatactatataataaacatatagaaataccaattctattctctgtacatcaagtttaagctgtcatcttttaattttacctttaattcctgttgcaacgtgagggaagaagaggtcaccagcatccgtgttaagttttcaattttctcattctgtactttctgaagcaaatctttttcttccaaaagttgggccaattggtctttttccattgcctgagcccgcgtctctaaagaaacctatagaatgcaatattggattatgttaataataaatgtggctaagttttaaaaccttaaagtagcataaaagaataaaatattaaatttgtatatgaactataagaattttaatttcactgaaataaaatatactctaactgtagaacaccaaaatgcagttaccataatcaataatttctcagacttacaataaaatacacatttcttctcatgtaactattctatataccatgtataagacaccaatgctgttaatataactctattaattgcctaagaagatatgaatagtcagaagtcataaaacaaagacttgaattctgatagtaaagatagagatgttctcataagattaccatttgatattttagctcattttaaaaaagatccttaatgcgtgattttttacaaaatatgggaccatgatggttaaaacaaactaaaatgataagtaattatgctatattattagattgctatctaagggttagaagaggaattcaggataacatgaaaacacagaaggtggttctaagtaactctgtagtttctctttttaatcgaattcatatgtatttgtgaaaaattttaagaaatgtctctacttggcccatttgataatctcagattttgcccgttgaaaataaaaaacaaaatctaaaataatttcaagaaccaaatcttacaatttatagtaaattaaactaaaatttttatgagtggatttcttcttctttaaaagtgattaaaaacctaagttgtagcaactcagatattcaggaatgaagagtctctgagcatttgggcaggtctccattctaaattggttctttcaatttaatgaaataaatgattcatacatacctcctctaattgttttttaagatccattatttcttttctataccttttcaggagagcttcatcagttgatacctcattaacataaggagtattcttcatatatttagcagtactggcaaactggaaaaaaaatacgaaagtgctaagtgttcaacacttaaaaaaattcgaatttaattaataatatttagctttcttatattcaagattaaaaaaatcaatactctttctagttggcttaatacttttgaacaaagggaacattctatgtccttataacaatgctctgtaacttatcctgggtgatagtcttcgggagaataaaaaagatatattgagagaacttaaaaacatcagcttattggaatctcatttacccctcaaggtccagtgctaacgcctcctctactctgaagttttgcttctagccaaaaatatctctccttcctttaaactctatactagttattaaccacttaactactaatcaaaggcaattatgttgcaagacaagtgttatgtgccttgtcacagaattcattaattctgttaagccagggactctagtttctctttgcacctctgacagtaccttgatctggtgctcaacagctatttaaagcaatgtttctcagagtataagtaccataagtaactttaggtgggtacaccaaggtgaccattagataacattgaatccttcattgagaaagctaccctactgatatttctcatttttcctttccttttttttttttttgttttttgttttgagacatagtttcgctcttgttgcctaggctggagtgcaatggcgcgatctcggctcaccgcaacctctgcctcctgggttcaagtgattctcctgcctcagcctccccagtagctgggattacaggcatgtgctaccacatctggctaattttgtatttttagtaaagacagggtttctccatgttggtcaggctggttcctttcctttttaaaatagaaaatgtaggccttaggctcagagaaaatgaaggcaacagttaactaccaggaatttcagaattattttgttatacagacagacacacaattttttttgttaccttctatttgtggcaagtaataatagtttcccattgataggactaatattaaagtttccttttacaataaattaagtacaaaaagtgagttattttaaaaatatcaagtcaatttcagtaaaatagtgttgggtgtggcaaaaattatgaaggtaagatacaaataatcgaagtctggcaaaattaaattaagaaatgctatttagtagacaacatatcgattataacaggcgagttaattaaaaaaaactatgcttaattttagtaggtaatgttttcttcttcaagctgatcttcccctatattaagctgagataaaaatcaaactcacctggagagcagtaagtgtttcatcaaaagatactggagtaattgtgcagataatacgtgtctttgcatttcctcccaaggaattctggagaattcgtgttaacttgctatctcgataatttatgaaaccacttagcaaggaataagtttacaggagaaaaagattgagaacgtttatataataaagtagttggtttttaatgcagaactcttaaatcagccagagtttcaaaaattagtttacaagttatatgaggcagattaaaactactaaaaaatatttaaaacagaaagtaaattcagtagattataatcatatgtataagtttttgaatatatggaagaaatcagtacatttgagtgtcatcgaaatgttgcaatgttcaacctaatgaaaaatataagaatcagtaggtaagtgcacaacgggataaacttacccaacttgtccatcactaagtttcttgatcacttgtcccaaaataaataagcttcgatttatattacagccttccttgagccgcacacctgaatttattaaacaaatatgaaaactaaacttgactccttttctagatgataaacttatttatcactaagttaatgagagaaattagagggcagatgctaaagtctatgctctggtttagacatgagcccatctttaatatcagtggtagaaagagctctctccctattggtcccacttcaagtgaatcagaaaggttattacctgagaaaaatagtaaaaagaaaaaaatgaagagggagggaagaatgcagggaaaaaaaacctgtttcctgaaagagcttctctagctcttcagttcaaatcaatttttttccaacatctaaatataggcaactatgaacttacaaccaaattagcctctaatttcttatttttaaattgttaatatgctcacacggttcaaaaagtttaaaaaaaaagtacactttgaaaaagctcccttccacttttatccccattcaaccagttcctatacctctaccaggaaaccactgttattagtttttttctttagagatttttaaaaatacaagttcgtatgtatttatttccttccttcttcactgatatcaatagtaacagtccatacatactattttgcactttgctttttctcacttggcaacatatcttggaaaaatttccatatcggtaaacactgatctttttcattcttttttaaagtataaaattccattttacggctgcatcagacttcattcacccaccccatcccctgttgaaggacatgtaggttttcagtctactgcctatacaaaaaaaattgtaaaaataattttgaacagatgttatttcacaggtgcattaattagctattgctttaacattactacctaaccaaccggctaaaacaagcatttattttttgttcacaggtctgaggatggactggtttggtggatgtaggctaggctcagttgagtggctctacaataggttgcagaatgagctcaagtctgttgaacaaacttctaatcttccttggatcagcagctcttctaatggcaagagtgcaggtgcaagctaaaccatttaagcattatgaactattcatttatatcctttgcccagttttttgttggtttcttttaagcttttaaggcatctggactttgtatcagttacaaaagggttttcccactgtaagttgacttccaacaatttttagtttttttatattgaaatttttgagctacttataatgcattccttggtgtatgatatatggatccgacttaattttttttcccaaatggctatcaattaatgaataatctatcttttctttacaaatttgaaggaccatctttattgtattctaacttctgtatgtatttgggactcttgatggattttctattctatttcactgggctgacaattcacacagttttaattactatggcattataatatgttttactatcttatagtaagatagtaaaatcttaaattccactttctgctttttggaattttcctggctactcttgtctgtttttatgtttccatacaaattttaaaatcatcttacctaatttaaacatgaaaatgtactcttgatagtcttattaggattgtgttaaatctagaaattaacacagaggcctgatatccttgtgattttgaatcttttccatttaagtatgcttctccattttttcaagtatttgtttgtgtccttcaagtctgatttacaagttttcttaggccgggtgtggtggctcacacttgtaatcccagaactttgggaggccgaggtgggcgggtcacttgaggccaagagttggagaccagcctgaccaacatggcgaaactctgtctctactaaaaatacaaaaattagctgggcgtgatggtgcatgtctgtaatcccagctacttgggaggctgaggcatgagaattgcttgagcccaggaggtggaggttgcattgagctgagatcgtgccactgcactccagcctgggagacagagtgagagtctgccttagaaaaaaaaaaaaaaaaaagttttctttatatcagtcttgtacaaatctttgttgagtttcttcctagatatcacatcttttaggttattataaatggagtctttttgtctactaaatattttaacttgtttttattaatattttaacttttaaaaattaatatctgcatattaattttgtaccacattatctttcttaatttccttattttgaaagtttaaatggtttttatggaattctcatgggctttcctgctgtacaatcccatcaattgtataattttcattttttaattgatgctattgtagactaaaataaaaattaagcagatacagatgctgatttctatgttaaacttttatcagaaaatcacaattaatgattcattattattaataatgaatataattactttatcaatttctaaaaatgcctggtagtactttttaaacctgtaaaataggaagacattaagactaacatatttcatgagttttaattacctgcagcgcctgtttgagcagctctttcactgcctgcaagatcaaccaaattctgtaagatagataaaaataaatccttagggcagataatttgaaataataaaattcaaactactgaaagaacatttttaatacatggtatatctgaatattcgatctgtatccatgtctcccatgctactgtttaggcattcccttttttctctgagtcaaactgttctctatctgttcctttctttatatcttccataatgccaccagtataggttctgtttcctatacaaggtccaaaaacttactatggcaaatataattctttataagctggcacttgcactgctccaactttgtatttatccatcccttattcttacctctagctgaactactcactattccccaaacaccccatgtacttctacacctccaagcaccagctttttgctatttcctttattcagttagttctaatgttctattctgtccttattctttattcaagaaccaggcacaaagattatctcctcagcatagctttgcctactttatccttcctccccgccagatttcagatgaactgctccttgaactgcataaccagaaatctttataaacatgacttatagatacgacttacatttatagcacttattttgttgggctagtcatgcatgctagctgtactatgctgtagcaataccatgactttactgtggcatctttaagagctggacctctctttcatttcacaaatattactgaaaagaagtggctgcttattatgctccaggaagtacatcaggtgctagggctacaaataaataaggtctctgctctcatggagcttacattctacatagaggaggaggctggtaagaagagataaaaagacaaataagaaacatgttgtgataagtgtaacagagattatttaaatagagctggaaaaggggccagtagctttaggttcataggactggatagcagtggaaggcttgtcattaagctgcgatctgaatgacctgagaagaggaagctggtcccaaaaagatcaagggaaacagtagtctagacaaaaagaatagccaaaacacttagtcacaaagcagaatgtgctcagtgtgttcaaaaaaatagaaaaggcagtgtggcacagttggtgaagtgaagacaggaaaagacagaataagagaagtagacaggggccagattatgcaggactttttaagtgagatctaaaactctgaaatgtttatattcaatgagaagccattgcagggctttatgcaagggagtaatagaaccctgccttgctagattggggaagttctcctggataatatcctgcagagtgttttcctactttgttccattctccctgtcactttcaggcacaccaatcagacgtagatttggtcttttcacatagtcccatatttcttggaggtttgttcattacgttttatcaaattcaggaaatacagagaatgccacaaagatactcctcaagaagagcaactccaagacacataattgtcagattcaccaaagttgaaatgaaggaaaaaatgttaagggcagccagagagaaaggtcaggctacccacaaagggaagcccatcagactaacagctgatctctcagcagaaactctacaagccagaagagagtgggggccaatattcaacattcttaaagaaaagaatattcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaatagccactgcaaaaacatgccaaattgtaaagaccattgaggctaggaagaaactgcatcaactaacaagcaaaataatcagctaacatcataatgacaggatcaaattcacacataacaatattaactttaaatgtaaataggctaaatgctccaatgaaaagacacagactggcaaattggatagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctcagagacctacaaagagacttagactcccacacaataataatgggagactttaacaccccactgtcaacgttagacagatcaacgagacagaaagttaacaaagatatccaggaattgaactcagctctgcaccaagcagacctaatagacatctatagaactctccaccccaaatcaacagaatatacattcttctcagcacatcacacttattccaaaattgaccacatagttggaagtaaagcactcctcagcaaatgtaaaagaacagaaatgataacaaactgtctctcagaccacagtgcaatcaaactagaactcaggattaagaaactcactcaaaaccgctcaactgcatggaaactgaacaacctgctcctgaatgactactgggtacataacaaaatgaaggcagaaataaagatgttctttgaaaccaatgagaacaaagacacaacataccagaatctctgggacacatttaaagcagtgtgtagagggaaacttatagcactaaacgcccacaagagaaagcaggaaagatctaaaattgacaccctaacatcacaattaaaagaactagaaaagcaagatcaaacacattcaaaagctagcagacggcaagcaataactaagatcagagcagaactgaaggagacagagacacaaaaaacccttcaaaaaatcaatgaatccaggagctggttttttgaaaagaccaacaaaattgatagaccgctagcaagactaataaagaagaaaagagagaagaatcaaatagacccaataaaaaatgataaaggggatatcatcaccgatcccacagaaatacaaactaccatcagagaatactataaacacctctatgcaaataaactagaaaatctagaagaaatggataaattgctggacacatacaccctcccaagactaaatcaggaagaagtgaatctctgaatagaccaaaacaggctctgaaattgaggcaataattaacagcctaccaaccaaaagaagcccaggaccagatggattcacagccgaattctaccagaggtactaggaggagctggtaccattccttctgaaactattctaatcaatacaaaacaagggaatcctccctaactcattttatgaggccagcatcatcctgaaaccaaagcctggcagagacacaacaacaaaagagaatttcagaccaatacccctgatgaacatcgatacaaaaatcctcaataaaatactggcaaacagaatccagcagcacatcaaaaagcttatccaccatgatcaagtgggcttcatctctgggatgcaaggctggtttaacatacaaaaatcaataaacgtaatccagcctataaacagaaccaaagacaaaaaccacatgattatctcaatagatgcagaaaaggcctttaacaaaattcaacaacacttcatgctaaaaactctcaataagttaggtattgatgggacgtatctcaaaataataacagctatctatgacaaacccacaggcaatatcatactgaatgggcaaaaactcgaagcattccctttaaaaactggcacaagacaaggatgccctctctcaccactcctattcaacatagtgttggaagttctggccagagcaatcaggcaggaggaggaaataaagggtattcaattaggaaaagaggaagtcaaattgtccctgtttgcagatgacatgattgtgtatctagaaaaccccatcgtctcagcccaaaatctccttaggctgataagcaacttcagcaaagtctcaggatacaaaatcaatgtgcaaaaatcacaagcattcttatacaccaataacagacaaacagagagacaaatcatgagtgaattcccattcacaattgcttcaaagagaataaaatacctaggaatccaacttataagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcattgccatccccatcagctaccaatgacttttcttcacagaactggaaaaaactactttaaggttcatatggaaccaaaaaagagcccgcattgccaagtcaatcctaagccaaaagagcaaagctggaggcatcatgctacctgacttcaaactatactacaaggctacagtaaccaaaacagcatggtactagtaccaaaacagagatatagaccaatggaaaggaacagagccctcagaaataatgccacatatctacaactatctgatctttgacaaacctgataaaaacaagaaatggagaaaggattgcctatttaataaatggtgctgggaaaactggctagccatatgtagaaagctgaaaccagatcccttccttacaccttatacaaaaattaattcaagatggattaaagacttaaatgtgagacctaaaaccataaaaaccctagaagaaaacctaggcaataccattcaggacataggcatgggcaaggacttcatgtctaaaacaccaaaagcaatgacaacaaaagccaaaattgacaaaatgggatctaagtaaactaaagagcttctgtacagcaaaagaaactaccatcagagtgaacaggcaacctatagaaagggagaaaatttttgcaatctactcatctgacaaagggctaatatccagaatatataaagaactcaaacaaatttagaaaaaaaaaaaacaaacaaccacatcgacaagtgggcgaaggatatgaacagacacttctcaaaagaagacatttatgcagccaaaagacacacgaaaaaatgctcatcatcactggccatcagagaaatgcaaatcaaaaccacaatgagataccatctcacaccagttagaatggcaatcgttaaaaagtcagggaacaacaggtgctggagaggatgtggagaaataggaacacttttacactgttggtgggactgtaaactacttcagccattgtggaagacagtgtggtgattcctcagggatctagaactagaaataccatttgacccagccatcccattactgggtatatacccaaaggattataaaatcatgctgctataaagacacatgcacacgtatatttattgtagcactattcacaatagcaaagacttggaaccaacccaaatgtccaacaatggtagactggattaagaaaatgtggcacatatacaccatgaaattctatgcagccataaaaaatgatgagttcatgtcctttgtagggacatggatgaagctggaaaccatcattctcagcaaactatcgcaaggacaaaaaaccaaacaccgcatgttctcactcataggttggaactgaacaatgagaacacgtggacacaggaaggggaacatcacacaccggggcctgttgtggggtggggggagggggggatagcattaggagatatacctaatgtaaatgacgagttaatgggtgcagtataccaacatggcacatgtatacatatgtaacaaacgtgcatgttgtgcacatgtaccctaaaacttaaagtataataaaaaaataaataaaaataaaaaaacgtaaaactggaaaaaaaaagagaaccttgcataaagctcagcaatgactctcacaatggatccactatgactactgggtggaggatggattgggaaggggcaagagcagctgcaggcagccccatcaggcagctggggcaggaatctcggtgagagataataccagcttgggttagggaggtggcagaggagactgcttgtaagagaagcagtgaaggggtgtcttgtttattgtttttttaatctcagagcccaacaccatgctcagaagacaataacaacttagtaaatattgtgagtgatttgaaagaaagtcaaagctttacgttatttctctctgtggagatttttgagactaggcaggtaaatatgtattaccagttaaggaggctaatttttcttgcacagtgtccactacagatgacacagatacataataaaagggcaaagtggtaatgaaggcagcatgagtgaaggttaaagatgagaacaagcattcatattcaaagatactcagaggcccaatctatgagggaggagttcatgtagagcagaaggaaataaagttagattggttaagagtggccaaatcttgccccaggaagtgatatacaaaagcaatggttagtatattcgaaatccttatgatgacttcaagaaacaaagacaagggtcatggagacaaggttccaggagactgacatagtaattcaagagagatgagaaagtaaatgagtgtagcacccatggaaatgtttaaaggtaggatcagtaagaaatgggacaagtggacaaagagaaaggcagaaaaagatgagtcaaaattgacttaggtttccagcttaggcagctaggataatgctggttttactggaaataaggaatattcactatggtaggaagaaaatagtttcgttttagacatattaaagtttgagataatgatgggacacaattataaccatctttaggaagacatgaattagaattcagagactataggtaaaatatttggcagtcatcaacatggaaatgatgacagaacatttgagagcaagaacttgagtaagaaacgtcacagaatacctccaagtttttttttttttaattatttttttaggagggtagggaaaaagaagccagggtagaaaacagaggagtacagctaagagaaactggatattatcatcccaccaaggccaggagataatcagaaaagagccacctctaaagagacagagatgactctttagagacttctttccaagaagattcttagagtaagtgggtaggctggagggttggaacagatggaacacaaatgacagagcatcacgtaacatgaggaaaatcatcaagtagatcactgaatatgccaagagtattaaagctaaattattaaaagttaaaattatatgaaatatcacagtcttggatgagaaaactaaagaggttagggtttggttttttattgttaaattaaaacaagattaaagtctactaaaataagttatacaattttatagcaaaatagctaaggtgaaattaggattgaatattaagtaattaataatctaattttataaaatctgaaaatgaataaacatattatagattgcttttttccctgaagttttctaatcaaataatcttaaatcatatcccacatcaagctaaagaatttaggccctaaaaatgcagaataaagcaatatggtaaaagatagaaaaggagcaagaaagaaacagcaataatttagtgtggaaagaaggaagtgaaggtttactaatgtggaatataggaatgtttgcataatgcatatattcgcttattcagcaaatctatattagacataaaataggtataatgtgttggggctaccaggatgaatgcagtatcactcctcaatggatttacagtctaaagtactacgtttacaatacaaaatatattttattgttgtacttaagtaaaacctaaagtaatgtgattactttttaaccatccaacctagatttttgttgatcacataagtctaaattacattggctgagattttacaaaaagaccctcaaattctaagatgatctaaagtgttaaatgtgtatagaaaaaaattctactgcattagtggttagaaaaaacatcaattcctataaccctatagccctgacatttaaattttaggagatggcaaccatgacataacaggaagaaagatcctctgaatttttcctacgacattttagctaggaatttgatgatactgacaagactaagcagacaatttgtagatttcctcccacatttagtttagttaacagttcttattaaaccaaacatccagcaactaaattaaattttgttttggcccatacagtacattattatggttcattaatactcaccaaatgggataccttaacagatccttcacaattagaaggttcacccttctctctgctttccaaaatctagatagaaaaggcaagctgtagaaaaattagtgcattcttacttggaaagatctaacagatagatagaattacctaccatcctaaagatggtatgagaacgactgcttctttgattcatttttgtttctccataatgcctgctctctgtaaaaatgagttatatttcagctgcatatataataaaatccatagaaacacaataatttttattttaacttaaaaaagtatgatttgaggtccaaacgtgcttgattgaaaagatagtttttacaagtgttctaaagaaatacagcataaagtcttactttctccctttgtaatccatttcaaagccatttctgatgtatatacaacttcttctgtgagatcagcaacatacacattcctctgaaacaagtttaattatggaaagattagagaaatagaagtcacaagtttgcttttcaaaagaaggtgcaaactattatagaattcatttgtgaaagttaaaagtggcaaatggaaccataattctgtaggaatgtaacaaataattctatgaatacccacaatttatttcacataccaaagcacaacaaattctaacctgatacttccaacttgctatttttacacttaaaccaaaatattagagctgtcagtattttaaaactattcatattgtttaaaagatgaatataaatacttcaaaaaaaccctcacatactatagaaataggagacactttaaaaactatagaaattaaaggtaaacattcaagaacaataatctcaataagtcagtcaattttaaagctcccttaagtctgctactcacattgacatcttctcgaataattaaaggtttcattttttgagtgccacagagtaaatctgtaatggtttcattgtatatttccatgtaagatacacgtaagagaaattccctatcaggaaactagaagaaaaaaaattatataaaaacaccaggaagcatccaattgtgaaaacctaatgctaaatgctcatgtgcttaaagaggtaaaatgtatgtaaaacaaactaagaaaccccttggttctactgttgacaaaataatgaacacaaaaatataaaagcatcgttacagaaataatgaaaagtgaagtaccataaagctgggagaacaccaactctaggctcaaactctaggctcaaaataaaaccctctcaaaagatgttcttattttaataaaaatgctaatttgaaaccaactaactcggttgcctattctggctttctgcttcccttctttttttacctacatccactttctactgttcctttataatcactgatagttaaatggttaggtggagctaaccattctgataacattttcttgttccttaatgcctactttttgttgagagtattattgttgcagaattcaagagaaagaataaaagaactttaagctttataaagtaagttgtggagataaaagtgaatctatgctatgcctttcttctttccccatggataatcaaacaataactgtaaatctacttcctttcatctttacaagagaaatacactaagactggtacccagtttttactagttttacctgtacgtactagaaatccagttaagttacttaccttcttaattttttggaaaatgtcatgaattgccctgggtataactcccaaatgatcttctgaacccatcatggtatatgtttttcctgaagcagtctgtccataggcaaatatagtacctgcaaaaaacaaaacacacatacgcaaagattaaaaacaaacctataatgggtaaaactatgcatgcttgttgcacagacgcccaagactaaaatgtttctgcagcattgagtgaatacaaaccattgtagccttgtatggcagaatcgatgattggtgctgctatttcttcatacacatttttggtagtttcattaccatgaaagacacgatctaaacaacaacaacaacaacaacaacacagaagttaaatcaaatgagtccactgtgttttcattccaaattagtaattattcccaaaagtaaaactgtcagaatgtaggatgatcaactatttaagacacagtatttttttcaactttttggttctctgaaaatacccttccctaaggtaaaatgagttcattttcacacacaaaaaatacactacaagtcaacttttctatgttctttcaagaggcaataaggtatagtgtttgcacatgggggtctggaatctacctagatgcaaattagataactgtgattataactgttttaaatgccaattggttaccttacttaaatacatgatggataaacaattttgtttccagtgaagcagtttatagaaggcttagtctaatctttagtgacaaatctaatattattgataagccttttgtacttttaatagcaaaaggataacaaggtaacttttgatgctattataagcttaccaaaattgaaggatttacttccatcaacttgataaatgacattattgtcagttttccagtaaacttgggcagtttctccaagtgattcttctctaaaagaataaaaacaccgcattttaaccagtcataaaagtcatgtcataggaggaataattgaaaagatttcacctgctaaagaatattttgaaagatagtaacataagagaatgacagaaagtccatctttgaggattcaactcttaaatggagcttcagtgaccttctgccgcctcaaaagtgttttcttgtgaaggctttcattctcaccctctcccccagtactggtaaacaaagggatggattcaaaatgcaactctgattatgtctgtcttgcttaaaattcttaaaaccttttggaaacttatgaaatcctcagcagggcacgagtcctagatcatgtcatttctctcttccattttcctctgaattcctagatacatcctaagctctacctgaaggtcttccccaaatgacagatgtaacctctctgtgcctggaatactctgacttccctttccattaagtaacatagggattatttcactcatgaaaagcgtcaagacttttctgacaccagttcaccccacgggaagctttcgtctctgatgggctaataactcctctagcaaacattctctacctgcccatcataacacttgtcaaaaggtatcctaatggtttctttatgtagccgtttaaggcattagataatgagctcctcaaaaataggaaattcctgatcttggtatttgcatttattaaaccccgtgttcaataaaaatttctcacacacacaaagtgttagcatttcgggtcgagggccagaagctagtgaagcaaaccgatttcatttattcctcttcctgctttttctccctagcacttattacctacatatcaccacttaacatcctacattttcaactttactttctgtctcgtcccattagaatggaagagccactgggcaatgacgggagtgtctgtgttgtacaaagtcactaaaaaaaaattgataaatatttgtagaatgatcttgagtgacgattgaatgtaatgtgacaagacagactagcccttgtcttcagagggtctggagacagcagttaggtgtaaaatgactaactgtgatgagggccaggaaggcacggtcccatacgacttctctaggcggggaatggggcagggaggagcagatgccgcaaggcagagcagcacagaagggaaggtctgtatgtcagcgagactgagttaaatttaagtgaatctcgcagctggaaagtatcttctagatctccgatcctcccctgtcactttacagaccctgaaacgatggccagcagccgagtcactagacagcagagccgggaagcagcggctcctggaaacatcgtaggcctcgcccctccggctcagggcggcgccgcaggcccagcgggcaccgggccgtggtgtggcccccctacctgctgttcagcggccgcactcgcacgcagacggccacggctccttcctccgccatcctatcaggctgaactggtcccaggaaaatggccaggaccctccgcggccggcacttcagggctcacaggccgccccgcctttaaattta

SEQ ID NO: 2113 - DNA, 51520 bp, Homo sapiens
attagacagaaatagaattttattttcttttaagcactgtattttttatttcttcattatagcacattaccctaatgtaatattcataagactggcatagatttgaaacttacctatctcccacctagaaatgggaagagcctaaagatatgggtcataagaaacaaaaaaagggctggattagggcactccttaggggaaggtagactcacatgggccactgaaataaaggaacctgggtggtcagctagggggcaggataaagttttttgacatctggagggggcaagaggatgaaccaatgaagatacttcatgtactttaaaattttggtgggaccaatcagttacagtaattcaaagaaaggtagtaagggaaggagaaatggagaagaggcagattatcagggtaaatgatggtaaaaattaatgagagactgcattatgatgtttaacaacaaaaacagatccaaaaaagagagccaaaaccaattcaaggcatcagagcctgggcaaatatgaatcaggaaactgtgaaagttaaaagttagggcaatcctagctgaagaggatactgaagctggtctttcccacattaactgtaaactgtggtagtacattaaagtagatatgtccttatgcaaattaagatggatgatgaaggggtgtttgaaaaaaaaggcagagagattaaggttggtgatatagatcattaccacccacatggaaagagcaagggctaaaaatgctgtttaaagaaacagctacacttttggttctattacattttaagcttaaacattacatatttcaatatgcatcttgaaaaaagtagcagctttctaaacattatgttcagcactctctcttttcacctctaaacttgcacagaagtctctccttgaacttcttcatctttattttgatgttcaactttctgcagaagcctggggcccagtaaaccaataagcagacttccaattggggctgtgatgaggatggacaaaaatgccactgtcaacacatccattccatagtcttctaattgtttctctccatgtgaccttgctgtgtccaaagccacagatcctattgcagcctataaaagtttaagggtaaaaatggaatcatgataagataagcacatataaaaaaagtgagttttttattgtttgcaaaagcaaattgcttgttcttttgctcaactaagaaagttgtaagcatcaggagatatacctaatgctaaatgacgagttaatgggtgcagcacaccaacatggcacatgtatacatatataacaaacctgcacgttgtgcacatgtaccctaaaacttaaagtataataataataaaataaaaaaaaagaaagttgttttagtattctttcaaagtgtattgcaggttttgttttgttttgtttttttacttttttagagacagggtctcgctgtgttgcccagactggtcttgaactcctggcctcaagtgatcctccctccttagcctcccaagtgctgggattacaggtgtaagtcactgtgcccagcccagctggttctgatgatctaaaaactctgcccttgcatgggaacatactgatgactcatttgtacttatctgtgtaaggtagggttacataaatatcagtaaaatacatttcaaaacacaaagcaaatccagaatcacaatattaattaaatataacataaagttctatgtactaaatttttcctgaataaagatggaaattactggtcatctccttttatctttaggaatgtggaactaaaaaataagatgaaaaacatgcagtgatacctactgaaaactgttaaattttaaataaatatatattactttagagcttaaactcattgtcaaacgtcatgaaacatgaaaatagtggacaccttgacaacttgaagttgatcttattaggtatttggtcaactccttgccacagaatttggtgaaatgttttatttggaatgcatctgttggaaaacattatgaaaattctcagtttcttttagaggcaaaatgcaatattatcagtgcagatgggaaaaatgtattaattaatctggttatcccttattccacagagaacaatgtaagcctctaagacaatgaaaaagaaaaatgtgcatcagaaacaatggcagaaactactagttgctcacaaaaacatgaatgacccctttcccttctataatagaactcctggagtttggctggtcacattgctgtccagagacctttttatagaactcttagccattatgttttagacatttttgaaagtctgataggggtgaggggaattctggagtaatgcccaaatgcaaagagcataattgaaatctggaatataactgctgagcatacacatcccccaaagcctcctaaatgaaaaacacttgattttaattccttaataacagaaattggaatatttaattataaaataatctggggcaaaacagttaaatgttgtttgatgtaattagtctgaaaatatacaaccaaagatacatcacatttgcaacaaatcataatctatacagttctaacttaattagcaatcatagatattctaacaaatgcatggtcaacaaattcaagcacctatctataatagctttatttatcacgtttattagaatgcacaaattttcggttaagtgattgagacatttgccaggaagttcagtgagttttgaataattaataccaactaataatctaggaaatcaataaagtgctttctgagttgtttttcaataaatcttttctccattacatacaaagactctggtcaagctcaactgatcatcaatcatattaacattaaaatatctccaaacattaagggaaccatgttatttctattttactctcttcttggaagctattaacatgaaaagagttaagaactctttccttgggtgacttacagagtgccgactgatgaaaactcttctctcctgttactactgctttctagtagaatagggatttactggatttttacttataccctggtgatctaaggaaatttaatgagctatcacatttaaggaatgaatataccaaaaatacaggttttaaagaatagattaggataaactcttttcataaatccacttcaattatttattttcactaaatttaaacaagccctcttattcaatatttcaaggtgtcatgcagaaatagcagttaaaatgctaagccatcctatccatcatacctgaactgtggcctttggaagccatgcaaaagaaataaatatcttttcttttaagttaaaaccagcaaaacacaccatcagaaatgtagtcaaaattcgtatcaatactgcaatgcctacggtggcaacacaaaggcctgtaagaaatattcaatttttagaaataataaaatactaggagagaaactgcatctcatggttactaattcaaaataaccatcaacagaaataatttttaaagcattaaaaattacaaatacaaaaatgtttaggaagaatatataaaaacaatcaatattaaggatcaatcaggctatttgtttaaaataaggtgtttctgtagattaaaaccagaaattaagcatatttgaattcttatgtagagatttgaatgttatatatgtcttatgctttatagcaagaaccatgcttgttcatgtgtgtaagaagaatttattaaatgatatgattaaatgataagtaataagctttaaactaagtactgtgtacacataaatgtacaatgtatagactttgcctcaaagtcagagaaagacacataaacaaccaattcatagactatacagtaagtgaggtataaacaaactaagggcataaaagagggaaaaacaatattttaacccaaaaagtcaataattctttacagggtataagaccagaagtgatagctaaaatatttatgagccagtatggagggaattagccaatcagagctggctgggcactgaccaatcagaatagacactggcagtctaccactgtttcaccatactgatgtgtactggtcgtactggtcccaattatccctggttaacatacacagctactccatttagtcctgtagaattctttgctgataaagacaagttcatcatcatttgccaaacaagggattgtgagtagtgctgctacatgctactggacctaagaatgatacagctaaggtgactcctgagtattagggtgattttttaaaaagtaacatttgttgagtgtttactctgtgccaaatgctgtactaagctttaaatgtattattttacttagtccttacaacccgtggagtaagtattattttatagttgaaaaaaccagaagctcagaaaggataagtagttttctcaaattcaaagggcgggtaaaacatcagacagacatagcgggaggatctattgtaaatctgccatatggcttttttatgggaaagttttgtggttctttgttgaaaggtatttcttcaaggttggaaagtattcaaaaatatctgtagcctgaagtacaagataaagagttgatatcattcccagaaggaaacattgaaagtttgagaagaggatgagaaggaagttttagttgagtttgaacgttaacaggacatacaagtggtgctgtccaatcaacaattggatatattgatttagagataaatagtttggaattatacagtttatagttgatgtcactagtatagataaggttagagaagttatatagagccagaggcacaaagttagaaagcaatttgataaagggcagcatttaagctacatatggtgtaaggaaaggctcaaacagcactgggaaataggaagtttaagaacttaatataaaggagtgttagagggtcaaaagcagcaaatgctgctgacagatcaagtaaagcaaagactggatttagcaatattaccttggtgagaggctggcaggttgtgtgagaggttggcaggttgtgtgataggcagaagctgggctaaaatgtatagaaggaggaaatgggaactgaagtggaaaggggaatgtagtgacctcttttgaaaagtccgaaaagaagacaagagaggtagcatggtagagacggggggaagtgaaatagaggaattttatatatatataattttaacatattattttaatatacattattttaattgtagtaaaatacacataacatttaccatcttaaccatttttatgtgtatagttagtatcattaagtatattcacactattatgcaaccaatctccagaattttttcatctcacagaatttaaactctatacccattaaacaacaatttccctttactcccagcccctggcaagtaccatttatgagtctgactactctggatacctcatgtaagtggaatcatacagggttagtctttttctgactggcttatttcgcttagcataatgttctcaaggttcatccatgttgcagcatgtgtcagaagagaagcatttttttttaagataagagagattggagactaaattctgaagagaagaaaattgcgacatggatatttaagatgtatgagaaaaggaaagaatccatatgcaagattcagaaggagtagcgggagatgggattcctagtatggatggaagaatactgtgatggaaggaaagaaggaaataatgagtacatatatacaaattaatttttaagtgcagtgttttgaatcaacagagttttaatatgatggcttttgaatgtaggaataaataaaataattaatgaacaacaaggcatttctatcccatgggtacaaactatagaactaactagttgtctttaaaattctcgctcttgttcaggacaaggctagatgaatattcttacccttggaaaaagaattgttaaggcctgaattttctgggtagtggtcagcagtgtcactttcatatacaaggaacaatattaaatgtgtaaaatataccatcttagatgaacaagcattattttctaaccaactactctaaaaaacttacatcataattaactttttatataattgtgacaatagtaaccactgtacacatacctgctggagatatttcaatgaatataaaaagtagactttattggtgagtaggctgaccaaaaaaagtgaattttaacaaaagcacattttgaaattcttacctacagtttctggtctgagagatgcaatagatacctctgctccaattagtccaaaaagaaggggctgaaaaatgtcccaggcaactgcaattatcttttcaacctctgcctaaaataacaataaaacacacacagatttttattatgtgaagttacaaatgcaaagaattttattaatttgaggtttgaattatttggcctgagataagctttatttctgtgccatctataactaaaaggttagctagaacagagcaaaaaaactgcatgaagatctttctatcacagttaagatacatgaggtgttttagcatactaaatattagtttgcacatggatattaataaaaagattcttataaagtaatcttatgaggactcctacttctgaatacatcgtgtgtatgtgcatgtgtgtatacatattgtaatatatagtagtgttttgtagtttaaaattttatgtcgactttccttcaacaatatgatttagagagcttgcaatattggtacatatatctagatatgcccctattactgctgcatagtgatctacagtatagaagtaccatagtttattcaatcatttctttattgacagatctttaaattgtttccaattttatctgtacaaaaaatactgtttaaggttatctcaaatcacgcacaaaaataaaatccaggtttactaaagtgattatcagtgccaattatcactttattgcccattatctccagctcctctttcactgttgctccacagaaaatggagctgggcctttaaaatatttttcctttgccaggtagcaccatgttaaactttgtcagtagagtgtgctaaagagatattgcaagctgaaggtgcttttcttcctggtttctgtggctcttcctagcaagatcttatagcatgcactggtggccttagctctaggttcctgcatcccaggtggcttctccagtatcagggtcctacaattcatgcaaccagcagcacctagtggccattacattccctagcatacccctggggcagtttcgtagcagattctcttgagcaagatacttccccatgcacccaaggggatggatctcctgcaaattgggagggtagattttcagcaaattctgcaagcacagcaccacagcgacttctctaggctctaacagagtctggatctcagccctgcaggcaggaatgtggagggtacaggcttaaggggatgatctattatagccataggtgctattctcatattctttaaggatgtcttcacatcttactagccaataccttgttactggaatccctggtgtggttaataatcaacttttcctattccagttactatttgatttctctttcctcataggaccctaattgatacaagaactaactttgtaacacataatgcaaaagactctaggaaaacagtgacacaattgactagagtaacatcaaaatgttttgtggcaaaagaagccataaaccaaaaaagtgacaaactagaagaaaatatctgtaccatgtgtaacagaataagaaacattggccaatcaataaaaaaaagacatagatcctaacagaaaaatgggcaatgaacccagagacagcatcatcatactgaataggcaaaagctggaagcattccttttgagaaccagaataagacaaggatgcccactttcaccactcctatttaaccggagtactggaagtcctagcaagagcaatcaggcaagagaaagaaagaaaaggcatccaattaggaagagaggaagtcaaactatttctcttcgcagattatactatacctggaaatactataccaagaatagtacagagatactatacctagaaaacttcatagtctctgctcagaggcttctagatcttataaacaacttcagcaaagttttaggataaaaaatcaatgcacaaaaatcattatttctatacacaaataacgtacaagctgagagccaaatcaagaacgtgatctcattcacaatcgccaaaagaagaacaaaatatctaggaatacagctaaccagggaggtaaaaaatctctacaatgagaattacaaaacactgctgaaagaaatcagagatgacccaaatggaaaaacataccatgctcatggataggaagaatcaatattgttaaaatggccatattgtccaaggctatttatagattcaatgatattcctatcaaactaccaatgacatttttcacagaattagaaaaaacattataaaattcatttggagccaaaaaagagcccgaatagccaaaagcaatcctaagcaaaaggagcaaatccagggatatcacactacccgacttcaaactataccacaaggctacagtaactaaaacagatggtactagtacaaaaacagacacatagacaaatagaacaggttagataatccagaaacaaaactgcacacctacaaccatgtgatcttcgataaagctgacaaaaacaagcaactggtaaaggaccccctattcaataaactgtgctgggataactggctaaccatatgcagaagattgacgctggaccccttccttacaacgtatacaaaaataaatttaagatgaatgaaagacttaaatgtaaaaccgaaaactacaaagcccctagaagatctaggaaataccaatctggacattggcccaggcaaagacttcaagatgaagactccaaaagcaattgtgacaaaacaaaaaattgacaaatgggaccttcttaaactaaagagctctgcacagcagaagatactatcaatggagtaaacagacaacctttagaacaggagaaaatatctgcaaaccatgcatctgacaaaggtctaatgtccagaatctttaagaaactcaaacaaatcaacaagcaagaaacaaacaactccattaaaaaatgggcaaagcacatgaacggacacttctcaaaaggacacatacatgtagccaacaagcatataaaaatgttcaacatcactaatcaatggggaaatgcaaatcaaaaccaaaatgagacaccatctcacatcagtcaggatggctattattattttttttaatatttaaaattaaccacaatatttgagcttgtggaagtaaactgggtgaccaaatgtcaaaggaaacataattgtacatcttttgatactttttaattttttgaatatttgagcttgtggaagtaaactgcgtgaccaaatgtcaaatgaaacataattgtacatcttttgatactttttaattttttgaaaaaatttattttaaattcaggggcacatgtgcaggtttgttacataggtaaacttgtgttatggcagtttgttgtacagattatttcatcactctggtattaagcccagtacccattagttatatttttcctggtcctctccctcctcccaccctccaccctacaataggccccagtgtgtgttgttctcctctatgtgtccatgtgttctcatcatttagctcccacttataagtgaaaacgtggtatttggttttctgtttctgtgttagtttgctaaggataatggccacccactccatctatgtccctgaaaaggacatgatcttcttttttatggctgcatagtattcgatggggtatatatacaccacattttctttattcaatgtatcattaatgggcatttatgttgatttcatgtctttactattgtgaatagtgttgcaatgaacatactcatgaatgtgtctttataacagaatgatttatattcctttgggtatatacccagtaataggattgctgagtcaaatgcatttctgtctttaggtgtttgagtaatcaccacactgtcttccacaatggttgaattaatttacacttccaccaacagaatggctattattaagtcaaaaaataacagatgatggtgaggttgtggagaaaagggaatgctgatacactgctggtgggaatgtaagttagttcagccactgtggaaagcagtctggagatttctcaaataaatagaactaccatttgacacagccattccattactggttatatacccaaaggaatagaaatcaccctaccattaagacacatgaacgtgtacgttcattaaagtgttattcacaatagcaaagacacggaatcaacctacatgcccatcaacggtagactagataaagaaaatgtggtacatatacaccatagaatactatgcagatatgaaaaatgaaaaaagctggaggcatctcactacttgaattcaaactatactacaaggctacagtaactaaaacagcaatggtactggtactaagacagacacatgaaccaaaacaacaggctagagaacacagaaataaagctgcacccctacaatcatctgatatgtcacaaagccaacaagaacaagcaatgtggcaaggactcatatataccatgtacatatataccatggaataccatgcagtcataaaaaataatgaaatcatgtcctttgcagtgacatcgatggagctggaggccataatcctaagctaattaatgcaggaacagaaaaccaaataccacagttatcacttacaagtgggagctaaacagtgagtccacagggacacaaagaagggcatgataaacactgcggcctattttaaagtggagggtggcaggagggggaggattgaaaatagtatgctgattacctgggtgacaaaattgtctgtactccaagcccttgcaacacatcatttatccatgtaacaaacctgcacatgtaccccttgaacctaaaataaaagctgaaaagaaaaaaaaaagaaacatgggcaaaacatatgcacaactaattcacagaagaagagatacaaatagtcacaaaatctaagacactaaaacggagtaattatgaaacacaaattaaattgacatgccttttttttttttcaagggggaacaccacattggaaaaatactaaaaggttttaataatgaaaagtattcatgactttgtaaggaaactcaccatttggcaggacaacaaattgataatgcttttttggagggcaattgagcagtacctattatactgtctaagaatttacatagaacagattttctcataactgaaaagaagctatatttttggatgacatttcaatgcttacaattacacaatttaaggatctgcaatatatacaccaggtcctcaaataatgtcgtttctttcaatgttgtttccttccaacaatgaaaaaaaaatcaattcttcatgttctccccatatctgcaagcattttatgtgggtaatctggtttcctcccaaatcccaaagatgttctcattaggtgaactgatgtgtctacatggtccctatctgaatgactgtgggtgtgtgtgaatgcaccctgtgatgggatggcatcctgtgtagggttggtgcctgggataggctcgggcttattatcttacttgtttttattaacctttctgaaatgtatgtgtagattacaattatttcaatgtttaatcttcacagtgttttggtttttattcagaagtttggtgatgtttttgtgaccagaaatatgcgttaggaacttagctcttgtttataccaattggcctatggtaaaattggttttgttatttgtcttttcacttaaagttgcagcttctgagaacctattgacaatgctaaaatgaggacttactattaatatattcagcagtttgacaaagaaggattacaatgtttctttgtattctttatttgcattatttctgatgtgtttatagtgggaagattatatttccattcagcttacaagtgttgaaagagagcatatgtgagggcattggttgatttatttaatagttctgtttctatagcatgaaaaatattatgttttcatcagataacgagttaagtttgaaccctccaccactaactgcaaggcacttgcctctcagcacctcactttctcatgtgtagaacaaaaggtttatattagataacatctaagatcatttattatgtaatggctagttctgccaaaactacgatccagttaacatccttccacatatctttaaattttactttttaatttagttttttgagtatattatagctaaaggtaagactttttttttttttttgaggcagagtcttgctatgtcacccaggctagagtgcagtggtgtgatcttggctcatggcaaccttcatctcctgggttcaagtgagtctcctgcctcagtttcctgagtaggctgggactacaggtgtgcaccaccacacccggggaagttttgtatttttagtagagatgaggttttgtcatgttgcctaggctggtctcaaactccagagctcaggcaatctgcctgcctcagcctccaaagtgctgggattacaggtgtgagccactgcacccagccaacgtaagactttagttgatactcattgtagtaaagaacaagaatcaactctattaattttagattacttagacttttgttgccatgaataattgtttaagagaagtcctcaaatgtgtttcatatactcagaatacaaatgaaagtaggactaaaaatatttctaatcaaattattttttatttctaaactgtagacaaaggccaaaatttgtttttgattataacactttagactagttgaacatcagacatgggcttatatattgcaaaacatagaaaaacatagaaaagtcacaatgtatcttcttgtgggtttttcataatgtcaaaactaaaatgaatttgcctataaagaaaatggagtcattgaataggctgtgtataaaagataagcccagggtaatgaagactgtgttgtcccttgaaaattaaggccatttgacacatttgtatgcatcattagtaagaatctgaaaaaatatcaattactttggaggaccaacaaaggagaaagttaagataaatggaagtttcatcatgagttggatatctacttaagtttatacttttttgaaagaacattttaagattcagaaaatccaaaataccgtatcaacaaaaaaatctgtaaaagtcattagaagcagcactagatttgacaacagacaaaaaaagagaagcagctttaaaaaaggtgagtgcatctgaatacaacaaacaaatggaaagattaatgcttataagaccaagcacaaagtataaaataatatcagaaaactatggacacaaacagaatcttataaaatattttagcttttcaaagtctaataagttaacaacaatattgctacagccctgtagaatttacaagtgtgtcattttcattttctcacataatagttacagcaattttttagatgattattgtattcactttagagttgagaaaactgagtatttcagaaggcaaatgacttgcttgggattatacagctagaaagtagtagaactgggattggcatcccaatctccatattttaaatcttatgctcttagtatgatatcatgctgttctggaggtaattataaaaataataagagttattatttactgaatgtgttctatgattaataactttccttagtgcttcgtacaggttattttaccgaatcctccagtcagtgaagttgtcatcatcactgggaagttagataacttgcacatggtcagacacacctagtaaaagctgtagtgttgagactggcctgaggagtctgagctcttggccctaggctatcctttagaataaggtaagaaaaggaatccaaactcaggactttggtttggttcctacaggaataagaactttcctgagtactaaattagaaaagatatggagagtacctgccacacgacagagtcaataaacattacttttccttcctttttttggggaaccatttttatatattcaaatggtatattcttttttttttttttttgagatggagtctcggtctgtcgcccagggtggagtgcaatggtgtgatctgggctcactgcaacctccgcctgccaggttcaagcaattctctgcctcagcctcccgagtagctgggactataggcgcataccaccatgcccggctaattttttgtatttttagtagagatggggtttcaccatgctggccaggctggtctcgaattcctgacctcatgatccgcccacttcgttctcccaaagtgctgggattacaggtgtgagccaccgcacccagcctcaaatggtatattcttatcctggctctgtcacttactttttgtccttatttttgaccttcgcaatatacttagtatttgtaggccttggtttcctgattttaaaagttgctctaatgtttacctttcaagattattgttaagaataaataacatatatctcactaacaaagagctcttcaaaaaaattaaaactattataggagactgacagatctgactacatgaaaatataaaatatctaagtgttaaaagtgaacaatataaaaaggtacaaagattacttagacttctgttgctgggactaattgtttaacagaagtcctcaaatgtatttcatacactcagaatagtaatgaaagtagaaggactaaaaagatttctatatcaaattattttttatttctaaagtgtagacaaaggccacaatttgtattttgattataatgcttcagactagttgaacatcagacatgggcttatatattgcaaaacacagaaaaacagaaaagttacaacgtatcttcttgtgggtttttcataatgccaaaactaaaatgaatttgcctataaacaaaatggagtcattgaataggctgtgtataaaagataagcccagggtaatcaagactgtgtcatcacttatatagatgtgtgtattgggggtgtatcttacagatggataatcaacacacattatactttggaagataatgaacaaaagacctaccaaagaaaaagaaaaaacacacaagtgtctaaatatgtgaaaaactgttcaatttcactgttaaagaaacacaaaataaacaagatgcaactttttacctatcagtatggctaaagattaaaagcaataatattttaagccagtggttcacagtgtggtccctagactggcagcatcagcctcatctggaaattaattacgtgcaaattctcaagccccaccacagtctaaaatcagaaatttgtagtagggcccagaactcaaatttaacaatccttctaggtaattctgctaaagtttgagaaaactattctaaggtgaagttgtaatgagacaggtacttcatattttactggtagaaaagtaaatggatagaactctagaaagcagtctggtaatatgtgtcgaaaacctcaaaatgttcatattatttcacccccaaattttactgttaggaatattccttaaggaagtgatcaatttctgatcatttcagcataatttaaaatagcagagactggaaataaccttataactatatataaaggaatgggtaaaaaaaccaaaaacccaactatggtgcatccatgtgtgtagataaagagattcacatagcagagttactagaggtaaatatttttaaaaatgttaatagttatctttctggttgtggggttacactgaccttctacatagcaggactacaggaaatgtaaacaaagggaacaatggtttggtttataagaatcatttatagataaccacattatagtttctctgaataacagtgtaatcggaagtgatcagtttccctttccctcctttttctttctgtgctcttatccagtgcccacttgcaggaggtatcagtctctccttcatttctctgttgctaaaactacttttttatgctctgtttcaaatgatattgctccttctcattgtttattctttttatcctatcatttatgaatttagaagctgaattttaaactgcaaaagtttagaattatgtttaaatacacatggtaagtgttactcaaacagatgtcaaaatataaaattgtgtcatgcacaataatgctacagttgtactacagcatagtacaactcaccttggagtcaaattaatctgagcttaaatctccgtgccattttctaattgtgtgaccttggacatgttatttaagtctttctgacttacagcttctataaggtagaaatcataatacttttcaaaggtaattttgtgaaaataaatgaccatatccacttagtgcctcatacagagccatacagcgtagcaacaaaaatttattaattcctttttctctttttacccatgacagtataatataatgagttgatttcaatttgcaaagatttttaaagagctggtgacagaatgcatttctgttacactgttgatatgagaatgaatgttatttacccacagtgaatgctgtctatggaagatccccacagagatccacttaattgagttatgattatatatctcatctcaaaatttgtaacgtttccatattttccatatggcattattttaattatttaagtttaattattttgaacagttgtcttcaggctttgtaagattatcacaaaatgatatagctgcatttattttaggtcaccgacatcttcattaagcagaatagcatacaatcctatcaagttcaaatctacaaaaatgaatctgaaaattaaaataaataaatgacaactagtgaacttccataatacatataaaccaaatgaatattcttaataatcttgaaaatcagtatgaaaaaccaaagcaaccttataaaaatggcaaaggcttttgaacaaactgggtagtaatcatatgaaaacatgattagcattgcccataaagaaatgaaaatcagaataataatgagatatatttttaattcataatatcagcaaaatatctcaaagacttagatcagaaaaacagatcctctcacataatattggtaaaaatataaattggtacagtcttttaaaaggtcatattgatattatcaaaagtataaatgtgagtactctttcctagagcaatctgatttctagaaatttattgtataaactaaaatatatactatattttatttattttaagacacatatttttatattttaacatttctgaaattagaatgttatgttatcgtttaattggcactattttttttctttcttggtgtcatataaaataattgtgttttttagaattgacagactcagatgaaatatggtatgtaaggatatattattgaagcactgtttatcttggcagaaaactagaaacaacgtaaatatctataaaatgcaatactccgtagccattacaaagaataaggaaggcattacggtagtatgaccatgatatattttaagtaaagacatcaagttatagattgatgtgtaaggggaaaaaaaagatgaacactgggtgtacatttgtatatgcacattaagatagcttttataatgaaatactttattaatttgatgctaagaaagtatctggaaagccaacttaatctcattagaaaagagtcatgagcagaaaaacttaaaatgaaattcaccttttcgctggtccatcccatgcctgcaaggaaagccatgaccaacgtgcacagtcctcctgatccagggaaaccaaaatgcacactgctgaacacagctagcacagacaaccccaacacaaggaatgttctcttacacacaagtttgtcctttaggagaaaaaaattcatttgctcaattatttcaaatccctgatttttaatgattgattttttccatatctaggatttagaaagaaaataaaaattaaaatgtctatataaatagacaaaacaagtgcactacataacatttactttctcttcttaaacaaaagcagagttagcacactgcaatggtgagctcttctttcaggaacaccaattctctcctctacagttatcaatgcagaatttcacagcacttaatgaagtagcagaaaaaaagtacatgagctttggagctggacagaccaaggttaaatttatagtttttatacattgttggtgtatgtagtagccacattacttaaccactccaagctttgtttcctgaaagcatttacatcatagggtttgtgtgaaggttaaatatatatctctattattttcaggctctatgtttactgttttaaatttgacgcccccttggtttttctttctaaatctttggaaaccaggaagctttaagaggttctagactgacagtagtttttgttgctgttgttttaaagtctaagaattgtgtactttttttccctttacttttccctgtccaggcttttaaacttcttgatcactttagaaagtaggtctttaaaagtgcttgacttggcaaaggcatgcaagctctgaaggtgaattacctgagttcattcccagttccaccgctttctagctatgtgaccttgttcaagtcacttatcctgcctaagcctcaatttccttatcagtaaaatggtcatagtaatagaaatctctttatgaactattttgtcggttgtactagagcagtgttttccaatagaatgtttagtgatgatggaaatgttctgtatctgctatagccacgtgtagctagtggctactgtactgaacaaagtggcactagatgatgattgactgatttatgtatgtgtgtatgcatgtatgtattagatatgggctcttgctgtgttgcccagactggactcaaactcccagagggatccttttgcctcagcctcctgagtggctgggactaccaggcctggctagaatctaaggtattttgatactaaaaaagggcacaaaaaagctattatatatctgggtttagttgagtattatgaacacttaaaaaacttgcatatcctattactttggaacgatattatttgttttacagtggaatttgaaatgtacagaatataatacgggaacccattacaggactgcattaaaatcttctatattgagcccacttcataaatctcatggatagcagtaagcaattttaaaatgaggaaccatttgctcaaacatgtccttcacatctgtctttgaaggaagtgttctagaatgttttcccaatgatatttcagagcacaactttcccacatattatttctttcacctggtcacggcttggaaagtactgaatgaaaaatccaagaacagatccagttgccacaccaattaccacctccaaaactcctctgaggacattaaagacagtagagcctgaaaaatatattaaaaaaacttagagctctaaatccaacaaatacacaggttttattccacaatcatcaacatgaagcatctaattacaaagaagaaacattttaaagacagtttctgctttccatattcttaaatatgtaagtggaacctacattttcccccatagcatataggatttaggaaactttaattaaaaaaaattttttgttagcacattgtgcagaaaattatattaaagtttctccacacataaagcacttcttcacagactgtcctaagaaaaatgtactaactggtttctgtggtctcttgttattatggcaatcattcttcttatctaaataaaattacctctgaagtaattttatttagctaggatcgctttctaccaggtaatgctatgactgttaaaaacatctagttgtgatagtagcattatgcttaagctattgtggtaataatttactatgaatgtgtagaaagtagctaattagctttagtctctggtatattgaggtgattaaaaaaaaaaagtcttgggccccacccctaaaaatctgattcagtaagtctagcagggctcagatccaaaaggtctaaggaccacacgtagttggtgggggggtggggcggggagaggaaacacagcagagtcaactaggaaggttcttcgagctgtagcttatgaaaaccccactgcctctttcctttctcctcccaccaccatgattctaatgcaaactctgttgctctaaagctgtggttcctattccaagctgcactggtttccactccaaaaggttctgatttaattgtctaagataggacctacataagagtatttttaaaaatcgcccaggtaattctagtgtgatggtaaggctgagaacaattgttttaaaggtatataccaggaaagtggtaagaacataaatttgggtatgtgtagtagcattaaaaataggagtatgaatttgacttaataggtaagagagcatcctcaaaggttcttgaacaagaaagtaatgtaatgaaaacaatgttttaagaaaatcaatttactagggaatggatggaaggcaggctctggagcaatgagacagggtgggattctaggtaacaggcataaatcatacacaatcacagaatggggagataactatagggagataacgagaatgtataacctgccaagaagatgtgttcccactacagaatctaaagctaaacttagattacaattatactttgtcaatcatataatgttgcaaattttatatcccaattttgaacataagattaagaaatgaacttaaacttgtgctgtaccacaggataataaaagtgttgaactgcttttggccttttggctaagatcaagcgtactatctgttcacatcagtttaatataggtgttgaacaacagtgggagaaaaaataacttaagttcctcttttactatacttgaaacaaaatacctcaatttcagacacttactaagtattaatgggacatccattaaaatcattgctgttattacccataaaaagctgaagaggagagaagagaaatttttcttattttaaaggcatgctgttcctttcacttggactgctctctgtcatttgtgctccttgaaaaacccactcatattttgtgtgaagtctccacacatcttttgtgtgaagtctccacacatcttttgtgtgaagtctccacacatcttttgtgtgaagtctccacacatcttttgtgtgaagcctgaacgttcctggatcacttcaagcagaaactgttctttaaatctttctaccttctaccgcccctgccgtactgcacctactgcatgctacttgagcagtctctagagggagcaagagagtaaagacagacagcttctggaccctccttaggtacagaactcttagtgttcttttgcctatttttaatttgccttaatcaattatcaagcaaatatgtcatgcttataacattttaacctacgtccctagaatgcaagagtaaagcctgttgtgaactgattaggttacctgtggaaaaggctatgcccaagcatgtgttgaagccagtgatggccagaatgtcatcgaagctgccagctgccatgagcaaggttgggacacccttctcaacaccatagcctcctccctgcaaaaggagcattgaaggcaccacaacagctggagatacagcacctaaaacaaaactaggcagacagcattttaaacatttatgataacatcttacttattactattttgaaattataatgccctccactttttaggggttatacttggacaacaacagtctttctttttttttttctaaattaagaaaacaaactttaataagaattgttttttgtttttttttcttttttttattatactttaagttttagggtacatgtgtacaacgtgcaggtttgttacatatgtatacatgtgccatgttgttctgctgcacccattaactcgtcatttaacatcaggtatatctcctaatgctatccctccccccctccccccaccccacaacaggccctggtgtgtgatgttccccttcctgtgtccatgtgttctcattgttcatttcccacctatgagtgagaacatgtggtgtttggttttttgtccttgcgatagtttgctgagaatgatggtttccagcttcatccatgtccctacagaggacatgaactcatccttttttatggctgcgtagtattccatggtgtatatgtgccacattttcttaatccagtctatcattgacaactacagtctttcaaatggcagagaagcatgaatccagaaaaacatgtatgtgtaaaacttctacagaacactgtttttcaaaatgtagccatagacaacttgcttcagactacttaggttgcctaaaaagatatatttattagtggtatagaaggcctaatgagggtaggccccaggatgctggcttttttaaacaaaaaaattcatgttataaggtttgaaaatgcatggactttctgatttggaacccagtgatgctaggccttctattagggcttgctatgtcaaataaggcaacagattagaagaaaacgatatgacagtcacattgataccagtaacaacagcagtggtaacagcagaaagcattttacagtatttactatgtaccagacaccattttgagcactttacacgtattcactaatttaatcctcacaacaaccctataaaatagacaaaatctatcttaattttataattgaggaaactgaggcacagagagattaaatacttgttaaagatcacacaccggaaaaatcacaaggctgggatttgaatccagggagtagagttccagagacttaaccatgagaagaatttcttacttcttgcctcttattagcactaaattcttactaagtcctgtcttatttatttactttgtgtggctcttaactgttggaagtaaagaactgacagtggaacgaagagacagcagaactgccaagtcataatagtctggtgacaggaggaaaacaatagtagctgttgatcactgttgctgtgtttattatcctttgtgcagacgttaggtggaatccggtatctctttaacaggcattgaatcaggtgtaggcaaaagaccacgacttcttcaacagtttgaatagtaggtgctaactgtaagagttagcgcctattaacacataaactatgttttgaagttagaatatttaaattatgctgtaacatctatgttgcattttctgatatctataagaaaattctattatgcattctcttgtatgcaatcagggaaagccctaaatgtccctacatattttcatatgacaaagaaacaatcattaccccagtataaatccccattgccatggtaaacccagcaggtaatgggcaagaagagcagatgtgcacgcctccacaatacagggacccatggacagtcttacacaaacgccctttaacttcttcagggcctgaaatagaaaagtagacatcctaatataatcctctgaagatgtgcagagaagatgaccttgaatgctttctcttcagtatatggaccacgtctgggtcatcatgagttttcaaggtaatgagttgtatttaacaaacattttagcactccaagtgttttcagacagcttattaagtcctcactgcaaccttataagataggtaatactattattatccccatatttttagatgtcctcatctgaaaaggcacaggctaaaggcatttgcccaagatcatgaaactggtgagtgatggggccaggtttgaacccaggcaggctgctttcagcatctgtgttcataatctctagctaatttaacattctcattagttttatttataatttgtggtcccagaatgagactaaagtgaagagcctgatcccccaagaaaattcattcctgtattcaaaaacatacatgaaaaaaaagcattaaaaaggcatacttgaccctcattttatatattaggcagtttcctgagctagtatagttagccctgaacacttgtatagggctttgcaaaccaaaaatatgttgttttctcccctgtgagcattatttataaccctggtctatatgtacatcagagaaaagtggggcctttattcttggtgctggccccatagacagactctacctttctccaaggaagagaatgagaccggctgggcgcagtggctcatgcctgtaatcctagcactttgggagggggaagcaggcagatcacctgaggtcaggagtttgagaccagcctggccaacatggcaaaaccccgtctctactaaaaatacaaaaattagccgggtgtggtagtgcatgtctgtaatcccacctacttgggaggcctgaggcaggagaatcacttgaacccgggagacagaggttgcagtgagctgagatcaagccgctgtactccagcctgggtgacagagcgagactctgtctcaaaaaaaaaaaaaaaggaagaaaatgagaccaccttttgagttattgcaaaccacaacaaggtctcacttgcaaaacaatcctccatgaaataaattctattttattctcaagaatgtcatgcaaagtgtccacatccatttcctaatgcttagtgattctgttagatacctgaagcattgaagaaacaagattcctatttaataatgagaaatttacatttcatacctttgaatccagaccaaggccagcacgaaccagaatgatagacagggctatgcttctcaaagaggaagaccacttgtgcttgatctgcacattatcgttgatgactgggatatttctgatgagaaaccctgcaagcagcatgccttgaacgaagaaatcaaacatatctagttagttttcaaatacagaaaatatttttagtactttaattttatacagactactatataatcccaggaaccacttcacttatgcttagaagaaattaagttaaacttttaagtaaaaattagtataataaagcagctaagaaaataatgtacagataaaaagatagattataataattaatattcccaaaataactgaacttaaaagggagacaagatgcagcatttggatagagagtatgatcaaattctaaatataaaatgttttaatacaatgccagctcagtcagccctttgcgtgcaaacagcaaacagcgcatgaaattatttgctatgtcagattacttgaaatatcaataaatacttatatggattctattttaccttcagattagataatttcataagagacagataatctactttgcaaaggttttagatgtcaattatgatgaaatggacattgccctgtcatgtcagctggtgactcttctttcactcagtcattcaactgtactgaatgccttcagtagtttagacactagagtatgtatcacacatataataatggattacatttcaacaagctttcagcctctagggaacaagacaaacggacaataccaattttatgaaggcatgagggggatgttacatgagctgaggcaggaagggggatttagagaagggggaagaggatgaagaaacggctaggggagttgagaagtttctggaaaagacagtagtttattcaaaggtaaaagaaaaagtgactcattctgaaaactgcaagtagttgagtgtaactgaggaagctgagtagttagtgagggaattctgccttcattgataccacatgcccacacaaagggaaaggtttctgtgagagactgagcctcttccctccatgcttctccagcagtgccctcttctcaccttgtccctataagcaccacacttcaaacaactaaataaatttactgaagttaggttattttgtgatgcaagatgggagaagagagacaacctgctgcacatgaaagcatcactccaggtatctctcatcactgccatttatctacgggaaagtctcgtaagttctgaatgctgtggcagtggtctttctggaatgtttattgggcaacaatatgaacaggcttggtttttggaagaaataatgatgagttatatatgcacatggtaaaattaagacattgctgacaaaatgtaaagtgacaagtacatactgtaccccaactgcaaccttccatcttcattcctgaatgtatttcactgttaagggtcttctgtgcccttccagaaagtttctgtacctattcaagtatatttctgtgtgtataagctcttttgtgctggacacaaataggacacttatacactgctgtacggcttgggtttttttcccatttaataatatatcctggacattttcccactgaagcacatatatatttgctttattctcttttaataactggaatagtatctcactgtttggaagttccataatttttggaccactaataatagattttaagaaacttttcaggtttttcattataaacagtgctgaaatgagcacaattcatacatcaagtatttaagtgcctgctacatgctagccctgtatgagatcctagtaacaaagaggtgagctagaccagcagtccacagcctttttggcaccagggaccggtgtcgtggaagacgatttttccactgatggcagggggaatggtttcaggatgaagctttccacctcagatcatcaggcattaattagattctcataaggagcacacaacctagattccttgaatgtgcagttcacaatagaactcatgctcctatgagaatctaatgtcactgctgatctgacaagaggcagagctcaggcagtaatgctcgctcacctcctgccacggcccggggcttgggcacccatgagctagactaatgtggtccttgtccatatggagcttatatatttgtaggtttacattaactatattcatattataatttcaagcagtggaaatgttaggccctatggtataggtatatgtcatttttatatatattgatagcttaacagccaaaaatactgcactaatgcttacattccattatcattacaatagctctttaatgaaatttaaaatgtgtttctaagccactcctaaattaacaatggcattcaatgacctgaaatcaaatggaatatcctaagaagaactcaaaactatgttaagaggtttttttgttttgggggatatgaggggacatttttttttttttttgagacagggtcttgatatgttgcccaggttggtctcaaactcctgggctcaagcgattcacccaccttagactcccaaggtggtgggattacaggtatgagccactgctctctcttggcctgagagagcatttttcattcctgaaatgaacgtgacagcagcttccctgggacactgtttcctttgctagtggtctggttgatgtaatgtgaccacctgattttgatttggcacatgtccccactcttgcctctagggcctcccctggtcatggaggaaagaacatcttcctggatagaggagtgttgttctcttaaaattttgtattatgaaaattatcaacacatggctaatctcatttcatccactcccaagttttttttttattatttgtgttatggaaattttttcaataatgatttttcttctcttccaaagggaagccgttttcaaattcatttcaggaatcaaaaatgctcactcatactccgaccctggcaatcacttcaattaaactcttaaaaatatagaacaggcaaccatcacatacattttgtcttaataagtttcctttatggattcagataatgcttcagttttggatactggccttaatgtaataagaaccagtaaactttcttcctctatgcaagtatacaactataaaaaagaatggtaaaatacatatataatttttgagaatgatttcagttaccttaggagatttcattttatcacaaatcccaagactttacatctttttgcaacatggtatattttgtttttgcaataggcatggagtgaaaaaaagacaaatggggtgtaatgggcattttcatgtgtctagaacaacagtcttcaacataggttgcatattagaatcatctggagagctttttaaaacttctgatgtccaggccatattccatttcaattaattcagaatctctggggtaagacctaggcatcagctttttttttttctttttttgagaccgagtctcgctctgtcaccaggctggagtgcagtggtgcggtttcggctcactgcaacctctgcctgctgggttcaagtgattctcctgcctcagcctcttgagtagctggggctacaggtgtgggccaaccatgcctggctaattttttgtatttttagtagagacggggtttcatcatgttgggcaggatagtcttgatctcctgacctcgtgatctgcccgcctcggcctcccaaaccagcagctttttaaagacaggtgattcctggcctggcatggtggctcacacctgtaatcccagcattttgggaagccaagatacgaggattgcttgagcccaggagttcaagacctgcctgagccataaagtgagaccctgtctctgcaaaaataaaaaaggtgtagggacatgtgcctgtagtcccagctactgggaaggctgaggcaggaagattgtttgagcccaggagattgaggatgcagtgagccatgattgtgcaatgattgtgcaactgcgctccaccctgggcaaatgagaccctgtctcaaaaacaaaacaaaacaaaacaaccaatgagagattcttatgtgcagccaagttctagaatgaatgatcttgctacataaaatgcgatcttagagcttagaaatgcagaatctcaggccatgaagacctacttaattagaatttgtattttaacaaattccaaggtcatcctctttacaatgaattttgagagtcactaattttgatgcaagggtcagcaaaaatgttctgtaaagggccaatgaatatcttaggctttgtgggctataaagtctctgttacaacttcacaactctgccagtataatgtgaaggacatagacaatatgtaaatgaataaacgtgggtgggttccaattaatattaatttataaagagaattagtctgcccaccctttatcctagcatataggcatatttaaaaacaattcattttaggcgatcattaaaaagtcaggaaacaacaagtgctggagaggatgtggagaaataggaacacttttacactgttggtgggactgcaaactagttcaaccattgtggaagtcagtgtggtgattcctcagggatctagaactagaaataccatttgacccagccatcccattactgggtatatacccaaaggattataaatcatgctgctataaagacacatgtacatgtatgtttattgtggcactattcacaatagcaaagacttggaaccaagccaaatgtccaacaatgatagactggattaaggaaatgtggcacatatacaccatggaatactatgcagccataaaaaatgatgagttcgtgtcctttacagggacatggatgaagctggaaaccatcgttctcagcaaactattgcaaggacaaaaaaaccaaacactgcatgttctcactcataggtgggaattgaacagtgagaacacatggacacaggaaggggaatatcacacaccggggcctgttgtggggtggggggagggaggagggatagcattaggagatatacctaatgtaaatgatgagttaatgggtgcagcacaccaacaaggcacatgtatacatatgtaactaacctgcacgttgtgcacatgtaccctaaaacttaaagtataatttaaaaaaaagaaacaattcattttaacaataatacaattaataactttagagaacaaaaagtttccatgagaaataatatgaattaagtggactatctttagttttacctaaaattagaaatacattgagaaatggggcatagtaagagataaataattctacttctttttatatttaactttaactactgaccacaagttcaaaagcagataattttggtgaatgttagcgaatcctgattgttctcactcatacagctaacagaaaaaaaaaaactgttcaggaaatgtgtgtaaatatatatgcatgtatgaaaggtaggtggttttttactaaaactgagtgattaataaatctgttagaaatgaacacaaaatgcctctgtggtaaacaaattttataatgcagaattcttttttttttttttttttgaggcggattctcgctcggtcacccaggctggagtgcagtggcgcgatctcggctcactgcatgctccacctcccgggttcacgccattctcctgcctcagcctcccgagtagctgggactacaggtgcccgccaccacgcctgactaatttttttgtatttttagtagagacgggattttaccatgttagccaggatggtctcaatctcctgacctcgtgatctgcccggcttggtctcccaaagtgctgggattacaggcgtgagccaccgcacctggcctataatgcagaattctttgaagaaacgttaaaggtatcacacctagttttaagactaatttgtgtatgtgtcttgtttgggcagttctcattgcctctggaagagtattttcagctatgtctttaagaatcatggtattttatttcatttttatcttttttgagatggagtctcgctcttgtcacccaggctagagtgcagtggtgtgatctcagctcactgcaacctccacctcccaggtttaagtaattctcctatctcagcctcccaagtagctgggattacaggcacccgccaccacgcccagctaatttttttatttttagtagagatggagtttcaccatgttggccaggctgatcttgaactcctgacctcaggtgatccgcctgccttggcctcccaaagtgctgggattacaggtgtgagccaccatgatcggccaatattatattttaaatatacccaatggtgtgctggtaaatgcttaacaggtggcttgccaaaaaagtatgcattttatataggcacatacattattaaattttactgatataaaggatgtgcagcacacagtttacaaatatacaaccatcttcactgtaaattctatatagccaatttattctcacagaatgttttcactgctgtttgtcaaacttctgtgtccataaccatctatggttgcagttctaccaagatttgacagaatcagactacaaataaatggttgcatactatctgattcagcaaagaagtcacatatcatgaatgagcaagtgcagtgttaccatgaatgttggttgatatttttgcttataagatgaaaatgaaacaataaaaatacatgtcagaacttcactctgtcaatgtcataagtgacttatactatgacaaactttgatttgtagcatttgctgattttttttgttgttgttgttacagatacttctaccatggccgattttaagctacaacatgatgtcactgaacgtggagttgggaagaggtggcagtggcacaccattatgtagtatttccataatctcaagagcataggtgaggggaaatagactaaaacattaggaagtcttcagtgttgagcactgaatgcttgtttttaatgtcagttaattttaagtatatatatatatatatatatatatatatacacacacacacacacatatatacacacacacacacacaaacacaaacatattttgagacaaggtctcattctgttgcccagattggagtgtaatggtgcaatcatgacagcctcgacctcctgggttcagtcaatcctcccacctcagcctcctgagtagctgggactacaggtgcacgtcaccatgcccggctaatttttgtattttttttgtagagacagggtttcaccatgtttgccctggctggtctcgaactccagagctcaagcaatctgcctaccttggcctcccaaagtgctgggattacaggtgtgaaccacagcacacgggccaggataatttaattttttaaattgctatgtttaacaactagattacagaactactcaaaatttaacaactggcttttggctccagcatggcaaatacagaaatattttattcctttatttcccaaagctttccaaactattatcttaaaaatatagtttactctggatagaacaggaaacatttagcacttaccaagaagagaaggcagtggaggcaatgtaggtaacttaataagccccaaaagtttaccaccaatgatggcacaatagaataggattataattccaaataggtttcctccaggaagacattcactgccagtaattgaccaaactacagcccacagaagaacaatgatggtaactgaaataaaccaggaatactagttactatcaataagttgtcacatggaggttttgacaaaatctaaaataatttgtaaaaataaatactgaatgaaaatgcaaatatttataatcatgtttaatctgtaaagagtatcagtaagatgaccaactgggtaactgccaacatcttaagaaatcggatattaccagtacttttgaatctgcctatgtgcccctccccatccatctccctttatactgccagaaggaaccattattttgactttcttcaccattcacttttttctttataattttaacacaaatttagttctgtcttgaattagacattattgttactttttttatagtcaatatttgtttagaattacctactaaggtaccttttttgaaatcatcattcattatggcatctcaaacttttctttctttttgttttgaaacagggtctccctctgtagcccaggctggagtgcagtagcacaatcatggctcactacagcctcaacctcccaggctcaagtgatcatcctgcctcagcctctcatgtagctgggactacaggtgtgtaccaccatgcctggctaatttcttaaaaattttttagtggagacagggtttcatcttgttacccaggctggtcttaaagtcttgagctcaagtgatcctcctgtctcagccttccaaagtgctgggattactggtgtgaacctcctcatccagcctcaaatttttcatctgggacaattatcctgctgcctaaagcatttcctttaggaaaagcatttctataagaatgtgaaataggccaggcatggtggtttatgcctgtcccatcactttaggaggtcaaggcaggaggattgcttgagctcaggagttcgaaaccagcctgagcaacatagtgagaccttgtctctactaaatataaaatataaaaattatctgggtatggtggtgggcatctgtaatcccagctactcgggaagctgaggcaggaggatcccttgagcccagaagtttgaggatgcagtgtgctacgattgcaccactgcactccagcctgtgttacacagcgataccctgccaaaaaaaaagtgaaatgtttccatttgaaaacttgtgttttacaaaactgtgcactaaaaattgaaaagtttatgggaaaaagagagttggggcagaccactcaaaactggtggccaaagcactaagaaaaaccaaaacaatcctaataagagtcttagcacagatgaatctacacactgacatttgtgtcccatacaggcagtctgttctttacagacttaaacctggcctcccatttcctacttcaagatggaaattcttgagggtattttctttaaacagagagcagttccatcaaaatctgatccatattttagccctctgcctcaatacaataaatttcaacaaaaggaaaagcgttggcagcttctttacctcagcttatactctcagccgcttcatccacatgtgttttattagatagcttaatgttgtagaatgtttgagtccttgaagcccctaaaccagctactaattgcatgaaaagtcagcacttccacagagatttcgtcctttaaaaggtcctcatgcagggaaggctttatctttaattgtaagaaagcatatatttggtcttttcttccccagttcactttgccttcacttgctattgcttgacgatacaaaatattatgggccaggaaaaattatacacaaaactgcaaattccatacactctaacaaaattctatttaccattgcatatgagctaattcatgacatagaaacactctgtatcacagcatgttgtatttctcaggagaatctgttacagtaaattcttagttgtatcatctggaattatctttattctcattcttaaaggatagtttttctaggtatacctcagttttatgttaaattctaggttgagtgttattgtttctccattccttgaaaatactattccttggttttctggttttgaagagcctgatttcagctttttaaaggaattctttttccttgttttcaacatcttctctttttctttggttttcctttcagtatgatgtgtttaggtgtgacttccttttgttttgcttaagatttatgttttttaaaaaaaatcagttctggaaaattcttagcctttatttcttcaaagatttcctcttccccattctctttttccatgttgctaaccctagttttcgtatctttcatctttgtgtgtactgcattctagataatctcttcacatttatttgccagttcaccatttttttcacttaatctgctgcctaatttgtccagtgagtttttaatttcaattactatcctatatctttcatttctagaagttcaagttggttcttcttcaaatctattcatttttaaaagttacttgttttgtactcatgttttctaattcttaacttctttatatatataaatgtcttatattctgttttctgataatgtacatttttgaaatctgtttttttgtttccttttgcatgttttttttgtttgttttttttttttttttagtttttttgcaatagtgagctctcccttggaactttgtctagtttgttttttgcaatagtgagctctcccttggaactttgtctaaaactaaactttttagtttgtcttttgcaacagtgagctctcccttggaactttgtctaactttgttgaagccttaggttgaatgagttttcccagatgggaatgaatttacttctaccatgtacttaaaagcttcccatccaagaccatctgaaaatgttttttgaaaatagatacattttcaaattgaattttttctgtgaaattggagacaaatcaggatgaagttaaacatttttattggcgactccacacctgccccagccagcaactacagttgagacaggtttagtcagaggccccatctgcagaacagatttacctcaaatttggcatcacactgggtttcaactttatatgggtgaaggagaatgctttttcctgttagacttctcccaacctgggcaggctctagcttagcctcctgtgctcacagcgctctcaaaatcaatctcaaattccctgaggtggatctagaactagaaataccatttgacccagccatcccattactggtatatacccaaaagattataaaacatgctgctataaagacacatgcacacgtacgtttattgaggcactattcacaatagcaaagacttggaaccaagccaaatgtccaacaatgatagactggattaagaaaatgtggcacatacacaccatggaatactatgcagtcataaaaaatgatgagttcatgtcctttgtagggacgtggatgaagctggaaaccatcattctcagcaaactattgcaaggacaaaaaaccaaacaccgcatattctcactcataggtgggaattgaacaatgagaacacatggacacaggaaggggaatatcacacaccggggcctgttgtggggtgggggtaggagggagggatagcaataggagatatacctaatgttaaatgacgagttaatgggtgctgcacaccaacatggcacatgtatacatatgtatcaaacctggacgtcgtgcacatgtaccctaaaacttaaagtataataataattaaaaaaaaagttccctgaggtttggtagaaacctccagggtggggccaccttgagtgcttactgacctctgctacttacactttggttttggtgtctgatgattccctgttttcttgacagatcatttcaaaagacttaaaacattttttcagatgatgtccttggtttgtgacaagattgttcattgagtctcatctaccatactgctagagactgaattcaatgtccctttttctaaaccctcacagaattgttccagattttctaggcttatgatactactgcagtggaatacctaagggacttccagtattttccaattagctacaagggttgaaatttctatgcgatatcagaggtagaatgggaaagcaggatttgccagctattatactaaattatactttatcatagcataaacccaagctaatattaaattcagcaaggtagaattaagtgttttctcttttcggctgggcgcagtggctcacgcctgtaatcccagcgctttgggagacgccgaggcaggcggatcatgaggtcagaagttcgagaccagcctgaccaacatggtgaaaccccgtctctactaaatacaaaaattagccgggcatggtggcacgtgcctgtaatcccagctattcaggaggctgaggaaggagaattgcttgaacccaggaggtggagcttgcagtgagccgagatcgagccattgcactccagcctgggcaacagagtgagactccatctcaaaaaaaaaaaaagagagatttttctacttcaagactattaaaaaaatctctctttccctgtgctttacttgaaacacagttgtaaatacatagcaaatggtatgtctataaggtttctctaaatcatgtttaaatcagttaacaatttacttctcatttacgattatggaaaaccacaaattttcacatgtaagatttactttttttatttttattttttgagacagtttcactcttgtcacccaggctgcagtgcaatggcacgatctcaacctccgcctcccaggttcaagtgattctcctgtctcagcctcctaagtagctgcaattacaggcacccaccaccatgcatggctaattttttgtatttttagtggagatgaggtttcactatgttagccaggctggtcttgaactcctgacctcgtcatccacctgccttggcctcctaaagtgctgggattacaggtttgagccactgtgcccagcctactttttaagaagaatactgatatatactgcataggcacaggaaaaaatataggacaaaagtcgtcttgtaaacctctggaacagaagaacagaaaaataagcgatgagatgtttatctaccatgaacctcatttttcaggctgctttatgaacgattatacatttttaaaaaatgtgtcccaaaattacattattcatttttactctttccttatgtcagtccatatctgtttcattgtaaacgttttaactataagtaggccatattttgaataataaaagtttaaaaaaataatgaaaagaacagaaaaggtattcaattatctgtgatcttatcagctagtgtatatttttggattctggttttctgtacatgttctaagtttgagattttcttccatgcttagttaagtaaactgacttggtttcattaaaaacacatctagagcctaaagtatagtatattatgcttatctttcattgtcccagatgataatggtaaacatgtctttcagagcccacaaagtataactatggaattgagtctcatttttcagtaaacatatgtgggcatccatatatttacttcaatgatgctattattcttgaacacaatttttgaaattgcctttaaattttctttaaaaggcaaatttagtaagacataaaattatgaaactattagaaaaaaaacataaataaaaagctccatgacactggtctgagcaataactttttggatatgactccaaaaatataggcaacaaaagcaagaacagacaaaccagattacaccaaactaaaaagcttttgcacagtaaacaatccacggagtgaagagacaacctacagaatgggagagagcagttgcaaactatgtacctggcaaggagttaatgtccagaatataaaaggaactcaaaaaactcaatagcaggaaaacaaataatccaatttaaaatgggcaaagacctgaatttttcaaaagaagacatacaaatggccaaacaggtataggaaaaaatgttcaacatttcacctcatgcctgtcaggatggctattatcaaaaagacaaaagataacaaggggttggcaaggatgtagagaaaaggtaactctgtgcactattggtgggaatgtaaattaataccactattatggaaaatggtatggagagtcctcaaaaaagtaaaaatggtactaccatatgatcctgcaatcccattactgggtatgtatccaaaggaaatgaaatcggtatgttgaagagatttctgcactcccatgtttattgcagtactattcacaatagccaagatatggaatcaaccctaagtgtccaacaatgaatgactggatgaagaaaatatgtgtatatacacaatgatatgcttttcagccataaaaaagaatgaaatcctgtcatttgcaacaacatggatgaacctggaggacattatgctaagtgaagtaagccaggcacagagagacaaatactgcatgttctcactcatatgtagaatctaaaacagttgttcatatggaaatagtaaatagaatggtgattaccagggactggggaggggaggagcttggggttatggggagagagtggtcaacaggtacaaagtgataattagataggaagagtagtttgttctgtaccacagcaacgtgactatagtcaggaataaggtattgtatacctcaaaacagaagattttctatgttctcaccatgaagaaacgataaatgcttcatgtgttagatatgctaattagctagatttgatcattatataatatatacatgtattgaaacatcatattgtaccccacaaatatgtacaaatatgtgtcaaaaataaaaataaataaataatgctgatgaatggatgtttatgtttttgaacaattctttttatattttgatgttaaaattatctttatcttttgaaaatatgatttataaaagtgaaaaattgtggatagattccaggcatttaaaagttggccggttaaaactagttttgccagatgcagtggtatacatctgtaacaagctacttgggaagctgaggtgggaggatcccttgagcttaggagttcaagacaaacctgggcaacataacaagatcctgtctccaggaaaaaaaaggttgggtgggggaggtgaaagtggcaggaagaccatgaccaatgccttgacatgtaattttctctagactttaaatctgaagatccatgaaaaaaaaaatgtacacacacgcacacacacacacacacacacacacacatataactcaagtatattgggtgatatatattgggttgttggtcacaggatacaaaatttcagttagacaggaggaataagtttaagaggtctattgaacaacatgaagactgtagttaataaatatattgtattcttgaaaaatactaacagtgaatgtattgtgttctcaccacaaaaaatgacagctatgtgaggtaatacatatgttaattagctaaaattagtcattccagtatgtatacatacttcaaaacatcatgttgcacatggtaaatacatacaattttatctatcaatgtaaaaaataaaataaattttaagtctcaataaaagaatactgtcttcttaaaaaaacctaatttgcctttatagataattttcaaatctcttcttttttctgctttatcacatattcccccagcatacacagcacagacacacatatgcacacaattcatttctgaagaaaaatagggcataaatcaatctgaacttccatatatttatcaaattgatggcagaataacctttggcttccttcaaagaccaaatccattcctgaaagacaaacatatacaagcctaaaaattttcaaaatagtgctgagataaactcccaaagaaaaatcccccaaatgtcttatgtaacagcaactctactaaaataagctgaattgcaaaccaatattcttacttataaagtaataggattcatctggaagtataaatggggctgtgtttgctaaaatattacttgcattacttaacagtaataacaacaaacgtttatgtagtgttttacagtcctaacgtaatcctgtgaaattactcagatatagtaaaggaaaaggtccttgatctgtgttccttcccccttcccacaatggtggtgaccacagtgatcctgaaagccaaggtgaagacagtggagccctgttagtctaggtccttcccttgaatgtgtggagcagagccacccatgtgtgtgaattgttcaccaactagtttttatgtttgggagaagtgaacttctttttgtcctttcaaccatattatttagtaatctgccattataacaacttcatcttttgccatctctttctgaattcatccttaccatttgttatgaccctgtccagtaaaccatgtggagggcaagccagcatttgtctcagtctttgtacgtgatttgcttcagttggtgtttcttgtagctttttttcactgcttttcaaaagaatacttccttctgttggttcatttgcatctatacctttgagcttcataactgtctcctcctgtgtttaaagtaattttaaaaatccttaaaactgtatatattttacacatatttataggtactgcatcatcaccttacaaatcaaatttctatgactagcatcaaggataacactttgtagaaaaaactcacagctttattactagctaatcagcttgaaacaagaatgatactaggagtatttagcacagtcactatttttagtacaggttgagtatcactaatctggaaatctaaaatctgaaatgctccaaaatctgaaactttttgagcactgacatgacacacaagtgaaaaattccacacctaaagtcacatgacaggtaacagtcaaatgcaactttgtttcatgtacaaattatttaaaatattatataaaattaccttcggattacctgtataaatatgaaacataaataaatttcctgtttagacttgggttccatctgcaagatatctcattaggtgcatgcaaatattaaaaaaaaaaaaaatccaagacacttatagtcccaagcatttcagataagggatattcaacctgtattataaatgcttgggtcacataacattttattatgttttataatactgggttttaaaataagcatatttaagataaaattcagggcaataattggcacatataccaaagtggtttagaaaaagataactatctgtaatgaaaaccacttcacattcattaatctacttgaatttaaacaataaaaaggaagaaaccaaaaccattctagagattaggtcagagacacaaagcgtttcataggctctccatttttctagttacaggtagggtcagctggcaatgatgttagctgggaaaactggtagtcacacctgccttggattgtgtaagtttggggataggagaattggtaaatgagtggtagaatatgaagaaaacacaattctatcacagcttagatttacctgtgcttcttgatgcatggagggcgtgtaattcattcctgtggatggttctgaatcttcatatgtaattcttttatcttcatcccccattatttataattaagaagatgacacagggaagaggaacgagatctgttttgaaagagtatagatatagagcagtaatttgaaagtcttgtgatttcaaagactttggattgtacttatttttttccctaaaaattccgaatggctaaactatttgaaattagactattcttaattttcaatggctggttattgtttttgcttgattctagtatattatcatcattcttatctacctttttatttttcttgaaaaagcctttgttgaccaatcacatttttatgatttctttcccatattattttttgagttaaacttaaaaacaatccaagcaatatcagtgttaaactgtcctctctcatgggccaactggatgaagcaggaagtctccaggtaactttccaatgttgatatgaggaatgagtcactaaagggaaatctctggatttcatccttttcggagaatctagagtcactaactcctgcctggttcttatttctaaattaaagtttaaaaatacaccacaattgactgagtagccagaatgtctcagacactatgatgagtgctatggtagtcactttttagtcattgtgggcaattcaaagattaccaaaacatattgtttgttttccattgacttatcatataccaggaaaaataaatttataccaaataactaagaaaacctgtaagactacggattggctcaataaacactcacttcaacacattctcccttggctttccatgctatacaggctacaaggcaaatacagcactccagttcctagccacttttgtaggtagaggtggccatgtgtcacagttctacatatgagatttaggtgggagttttgggggaggcctttagaagataatactttgtactttttgtcctctaacatttccctttctccttcctagaatgtagatacagtgcctggaagggcaacagacatctttcaagcatgagaataaaagccctctatttaggatagtagataagtaagataggagaagctggttccttgatgacatcttccagttgctccatcagccttggactgccaagcattggggtaattgtttaaaccactattaatcaagttttttcttcttttttaactagtaaggaaacttactcctaatgcaacaagtagaatgagtatcttgatagaggtacacactacaaacttgtggtagaatcaaagagaaaattatgtaagagaagggaaaatctaattcaacacatatcaaagtgcctaatgggttccaggcactatgctagacataaagacaaggatgaattagacaggacccctccctcaaggaatcattttctctgttcaacgaagtgccaagaaatttgcatttaaaacttcaaaaaacatcataatctttttaccacaaccacccccatttttcctacttacaaaacacatggtaaccagagtcccatctcaaaaaaacctttagtttgttttttattatacataatttgtaataaatgtttatataatgatatatatgtatgtgtatgtatgtttgtatatataattttttaaattaaaaaacttatttcaaaatttagactgataataaaaaagtcacttgatgagaaaatgttagactcagagaacacttgtcttaaaggcatggagacatgaaagccagtggtgtgtgaggggaaactgctggagcttgtggcaggaggctgagagtaatgcgagatcaggttaaagagttaggatatcatatctcaaaccacggcacttggcctttaccttctgaagtgaatgaccccaaatatggtaactgacaagatgggctgggttcgaatttggataagcctgaatttgaagtccatctataccaaattgcttaacctctttgtgattagtttcttatttatgaaatggagacaagaatagttctaactatgcacagttggcattcaatagtgttggttattgctaaccatgcatattccttcttcctgattatcataagaagaatctttaagaatcattttgctttccctattaagcaagaaaaagtcacctcaaccttgaagaatttactacttaatcccattgattttatttggtcatgatttttcatctgtttttgaggcccacttcttgatcaggtggatgtaacattcatttcttcacccttctcattaggagaattacatagaaattctttggcagtaccactagaattacctctttcatcaaattctcaaaatcagcccattctgccacttacaaaaactatttttaaatagtcgtgaattagaaattattatttttagtagacaaaaactattggttaaaatgaagcctttgcgaacaaattttatcaatgttattatggggtccttttaaatataaacaatcacaacttggcatgttatgccatctgtgggaatttatataattttacattccagaaaagttccctattctccaatactctcaaccataaatgccaaagtacttatacatgatcagaaaggtactgcagaaataaagggtaaaatgaaatacatgtcttttaatgagcccagtaagagatcttacaactagtcagctgtatttgtttgctctctgctgtgtttccatttctaaaagaccatttaaaatgcatgtctcacttcaggaacctacttaaatttaggaaaatttcaaaaatgttagctttacttaaagtgaccatgttcatggtatttattatttatagtcattgggtcttgaaattacaaaaatgacctttgaagggccataaaaaatgtcatgaaatgcttattagaaagtttattctccttactcatagagaggctcttaaggactcatgcagagcccattaacccttattttgttttgtttgtttgtttgatttttgagacgaagtctccctctgttgcccaggctatagtgcagtggcatgatcctagctcactgcaacctccgccgcctgggttcaagagactctcctgcctcggccttctgagtagctgggattacaggtgcccgccacctcgcctggctaattttttgtatttttagtagagatgggttttcgccatgtcagcgaggctggtctccaactcctgacctcagtgatccacccgcctaggcctcccaaaatgctgggattacaggcatgagccaccatgcccggcccttatttcgaaaacaattctaatgactttgctcctttgtttttcaaaccctcagaagattaggtgttaaatattaaaattcaggaagagattgctgtgatagaggcaaattgagagcagcattagtgactgatgacagtgaaagagatgaaaaagacagcaatctaagagtcatttatagtgggggcgacagagcaagactgtataaaaaaagaaaaaagaaaaaagttttcttaaccttttctccccacttgaaagaattgtccttaagagatcaagaatataagcagtttgatatatgtacctgttaagaaggaaacagaaaaaaaaaatcctttaacagcagttgcctttgggaagggaaatggaagaggagtggctggactttctttcttattttctaagaaagattttcttatgtaggattttcttatgtaatttgatatatatatatattttgttgttgttgttgttgtttttttgagatggattctcgctctgtcacccaggctggagtgcagtggcatgatcttggctcactgcaacctccgcctcctcggttcaagtgattctcctaccttggcctcccaagtagctaggactagaggcatgcaccaccacgcctggctaatttttgtattttttttttttttttttttagaaggagtctcactctgtcaccaggctgaagagggattgcaatggcacgatctcagctcactgcaacctccacctcccaggttcaagtgattctcctgcctcagcctcctgagggactacaggcacatgccaccatcccttgctaatttttgtatttttagtagagacggggtttcaccatgttggccaggatggtctcgatctcttgacctcatgatccacctgcctcagcctcccaaagtgctgggattacaggtgtgagctaccacacccggctaatttttgtatttttaatagggatgggtttcactatgttggccagaatggtctcaaactcctgacctcaagtgatccactggccttggcctcctaaagtgctgggattagagatgtgagccaccctgcctggccctaattttaaatacatttaaaaataatctactcaattcctaaagctttagagaaaagaaaatggtaccacatttcttggtaatatttctcatagatacagtctggtgatttgatttgaggtaacttaataacacctgccacaatttaaaatcattttttgtagttgtgatttttcaaagaagatgagtaactgcccagaatcaccaatagcagtggttttcaaaattttcaagtttggctttcatgttttttttttttttttttttgaggtggagtttcgctcttttgcccaggctggagtgcagtggcgagatctcagctcactgcaacctctgccttccggtttcaagctattctcctgcctcagcctcccgagtagctgggattaaaggtgccggccaccatgcccagctactttttctatttttagtagagatggggtttcaccatgttggccaggctggtctcaaactcctgacctcatgatctgcccgccttggcctcccaaagtgctgggattacaggcgtgagccaccgcacccagccctggtcttcatatctttatgtcaaatatctttcatcaaatgaaacctaatccttaaatcctacaaatggaacgactaaggtggcgctgcaggagccctgtctactcacccctgttccttctggcaagtggagcatactttggaaaccatttctgtaaatatgttttcacatagagagatatttgttaaatgttctctttttcatattatcttactaatgtaaatgtttacaagtactttctgtaatattccagaagaaataaaggaactatcaacttacaaatgtccgtaggctctcggtcaagtaaaatagacttactgctatcatttcagttactgctaaaagatatggataaagactttttattcttgctatttgctgcctgtgatttggataggctgacatttaaaggagtaatcttatggagaatttacatatattgcttgctatggcttgaatgtttgtgtccctccaaaattcagattttggaatgtaactgccaaggtgatggtattaagagggaggtactttggggaagtgattaagtcaccagcactcaaccctcatgaatgggactagtgctcttataaaagaggtcaaagggagcagcctagtccctttggctctttcccttccaccatctgagaacacagcattagtctcttcctccatgtgaagaagacatggcaagaaggcaccatcttgcaagcagagatcaagtgtgtaacagacatcaaatctaattagcaccttgacctaggacttcccagcctccagaactgtgagaaataaatttgattatttataaattaattagtttgtggtattttgttacagtaacaaaaatggactaagacattgctagagtactctgggttgtattcatgcctttgaaagagcatcactatgattgttcaatactctataatgataataataacaacaatctcctgcctttgtgttcatccattcatgtgttgaacgtataggttctcagtctcatacagtatttctacatagaacatacagaaacattccagtttctgtatttgcttatcaacactgatctaatggtcatttcccaaaaggagccctacccagcaatgaggaattcagatcaggctcagagtagggcttaacactttcttagacaattaattactaaaatgactaacagtgtttccctgaatgagaactaccttatctgaaagacttaggtgtgtcaaatacatgtggccaagttaccaaaggaaaacaaccgctattttatttggttaattgatttagtaatttcattgactcatgaaggaaaacactatataatgagataagaataaaaggaaattacccctacataagggacccaatacttgctttcatcctttctattctctctcctcaccaaagtgaaatatacttactaaaagtttaaaatattatttctaggcccactaaaatcagaatctacagagaccgaatctaccccaagtgggacagacatgacttatggcctgtctaaatgccaagtgttcaggtatgccagtaggacccttctcccgccctagggataagtcattattggtgtaaatcaatctctgtaacaccattcctctttgccacttattggctaaggagtgagcatgattcatttcttgccattggaatttgtaggcaagactattggggcatattacataagattttccttcttaataaagacagagagagaggaggaaaatcctctcctctttttgtctttaaatgaccaggtaaagaggcaagggaagttgggattgtggatgggtttcttgggacaattctagcagccatcattcacccatgaagaaaagtcaagattagctgaacacagaaagcaacatagagccctgatattactgagctactgaacaaaccctggacccacctaccttcaaacatcttcatgtatgagcaaagtacatctgtatttttgaagggagttttggctgaatatcctgttacttgcagccaaaagcatcctaaccaatataacaggtgattttgttgcagaaccatccctgagaagccctgatgaacagcagtgatgaggaacctctgtcttacaaactttagtttctatctttctagcttcttgttacagtgcaaaatcatcatagacaatgaatgatcagaacactgcctttgtattgaaatttctcaaaaatgtccagaaaataacattttataaagttaaaaattagtgccaaggttttcactgccattcttttagtcaacagaaattatttggattgtaagattatgtatttcccctcctctaccctgaagttaaattgtaatatttgaatactgaatgaagaaaagttggacttataaacgtttggttgttttccaaatttccactcatgaaacaaaacaacaacaataaaatatcactactattgctgcctggagtttcatttctgctttttctacttgaagaaattcaaaatctaactcaaatgtcaccttctcagtatttcctaactccaacattgacaaactgtctccctcgttttcctctctgatgattcattcattcattcaacaaacaagagctattaagctcttgttacgtcccagtccttgagctgaggattcagaagtgaacggtcttaaatagttcctatattcagatcttgtaatctagttacaggatgataaaggatgataaatgattcctaagcaatcacaatgaaatatggttaagtttcaactttagacacataacaaccccatcccttaacaagtttcatttccttttttttcttttctgagatggagtcttgctctgtcacctaggctggagtgcagtggcacaatcttggctcactgcaacctgtgcctcctgggttcaagcgattcttcagcctcagcctccggaatagctggaattacgggcgtgcaccaccatgcccagctaatttttatatttttagtagagatggggttttaccatgttggctaggctggtctcgaactcctgacctcaggtgatatgcccacctcggcctcacaaagccttaacaagtttctctggtgtgataggcacaagagtaacaaagatgactaagatgcagtctgccctttaagggatggtcagagactgatatgtgtttaccaaaatcgtttactcttctgcctgggtccatagtacatttccagtctcccttgcaggtcagtgtggcatgtgactgaagtctggtcaatggcatgtggacataaatagtatgtgatttccagtcctcacccataagaaacaatcctcatgcaatcctctagtagcttttctttttctgtccgttgcctggaaactaaggactccaaggtcttaggggatagcaaagccataatataaaaggagtttgggttcctgaataattgagtagaaggccaacagctgaacacgtgaatggacttgacatgaacgagaaataagcctgaactatgtttagttactgagatgttttactttatctcttacagcagctactgctgtcttaaggttatattcttcagtcaatagcatacgatgattcttagcacctcgaggatgctaacccagtccacaaaggcaacaccccctctggttaatctgagaactaaaataaaagcaagcaagaaaacccacgccaacaccttacaacagtaaacagacacgcgcccgtcaccgggtgtacaaacagaaaaggctgggcccctcgctcgcgtctccggtccagcaggcctacagggtacccgccgctggcgctgggtttatttttacccttagtgtctctggggcctctcacctggcagtctccggcgaagtcgaccaggctccgtctgaacgattaggaaaggggctgtgggggaggcggcggagcccggtctagccaccgcgctctggggttcccgattcgcgcatcttcccaggctgagccgggaggctgcgttgactgcagataaacggtctcagggcgcggcaccgcgtgtagtcggccccgcctttcgcacgaacccgctgggcgacaccgcgcagggaggtccgacccgtcggcgccggtacaggctccggagtaagcatgggttggtccggggcccgcagcggcagccccgtgtgccctccgccgggtttcaggtccggcggcgcgggtgcagagccgcgtgcgatgcctggtgcgcgtggcttcccccggaaaggtggcgccaggccgaccatgggcccacgtcccggggcctcggagcggcaccgcgcggtctttcagctgcttatcctccctgggcgggtccgcaggcttctggggccaggaccagcgagctcccgggaaagcttcccggaaagcttacccagagagcgcggacccaggcgccgagtcttcccggagatgacgagacaccgcgagaggagcacagcgcaggctcctcgggactccgcggcgcaggccgggcagcccgttacttgttttatcgttcccgaaaccaacctctaagttgtctatcagtcctccaccttttagctgtacctcttagaagtgtcttctcagctgcggtgggaagataggattctttcttaaggtgaccaattaaatggccggataaaagacttgttctgcccccctttatcgcttaacacctgccc

SEQ ID NO: 2114 - DNA, 118813 bp, Homo sapiens
attccatttaatattatttttattaaattaactttggagtaaaaagtccaagaaaagccctgtactgaaatcacatgtttactaaatcctggattctctgtacagtccccacatatttctactttaaaattcttctgtcatgtgaaataattcattaaaagaagcaggcagatgatgacaggtaaactttttaatgatgttctaatgttgacaactgcagttttattttgcttggatcataatggcgtgtaagcattttaggccccagaatgcccataagtagagctccatttggagctgtgatcaagatggctaaaaatgctactgtcatcacatccttcgcatatggttccaagtggggtgcggagactcttgctgtttctagagccagaggacctaacacagcctgcatttaggggtaaaaatggggcataaagaaaaatattaaactgagttgatatataatgtaaatggctctgttaaaataaacaaaatctagtactagactattagaaaaaaaaagtactcagtaattttcataagttactcatcagttccatgttcttcctagcaaatatatgtggaggaagagtacaatagtgacaaatcagcaggcaaacatttttgggctgattttgcactcttgtcctctcagtgttcctctattcgaatatctcttttgagtgttcatgttgccctcataacaccaggagttctaacgaaaccagttttgcttagttgcctttaccgtgtgcaagtggttcttgactacaacaagacaacataaaatactaaggtttcttatggttctctaggatttgttgcccttcttctcattgttctccctattcagggggcactgtgttatagcagaactgacagcaggcttggaatctagcaaaccgggtttgaattctatttttgctgcaaccaggctagtgaccttgtacaaatgactcacactctctaaccttctacttacttatgtgtaaaatgaagaacaaaatacttatcttactgaatggttgtgaaaattaaatatgagaatgcaaagaacagctggcacacagtaggtattcagatagtagtaagtttctctctccctcactcctcatgccctgccaggtcagagaatgagttcctttgaagttttcgttttagaatgactgtactgggtcacaagtttttttccctagtcaccttctaccacattatttttaataacataaagcaaatttcttgctaaccctctttctttgtgtttaataatctaggcatgaaattgccttaaaattttggggaattaaataccaatatataacatattttctatggagttgcaaagtaacaacataatggtggaaacattacctctgatatggaacattatggcaaaagaacccctcaatttaagatcaatttctatatcctaaatcaataatttaaaatggtatcatttttatatcgtaacttttaatgtactgaacgtgagccagtgtgctggaggatgctagggagaaaaagataatcatgcagaaaaccaacttgaaagaatcttacagtttagaagaggatttgaacataaaagaacttccaacagaaaaaacaaaaaacaaaaaccaaacccattgacttttaagagatgattatgataatggtgaaactagaaataatatttatatagttatatggcattcatcatatggcaggtatcattcttaaagctttccatttatcaattcatttaattcttacgacaaccttattatgtgaggactttattagatgataaatgatttcctcctagtgactgagatttaatattatttctttaaaagaatccaattgccaagctgatcttacatttgtaaactaaattatttatttactctcctaatagcttcatttttccactctaatttttatcagtaactcgaaactgaagaacaagagaaagagctgaaccttagccaattttatgttagcagcagagaacggtggaagaggataaaggtgaaaataatttaaaattgaaatttaaatatttgttgatcttatttacttgtgacattatcgttatctattattgctgttgtgactctacttgtataaataattaattttttatgtcttgccagttcctggaaccagcttgatattctttgtgtagaagctagcctgaagccagcagacaggaataggcagaagcagaataatactgcaggactcgagtgagtggtctctttcctcatacctgcttttcttttttccctgctttatgaaaattatgaaataataaaacaaaattgcgagagtattgttggaaggagagagaacagatactccttttgtagatttattattccctacagtagacattaaaaataaaaagttattatttatattacttgaaggtaagataaaataacaacattgttaattgagcaccaccatatgccagagagagtgctaagcactttacgtggattatctcattgaatcctgacaacactgctaagaaacagatacagtcatagacttcattgtaagatgagaacactgaaggactgagagattagaaaataattttcctgaggttataggcaagtaacatggtattcaaaacaggtagtcaggccctatgaacctgcttttctaacatgataatagaggttttttttgcatgaaaatttaggagcttctgttttggaataacaactaagaaaagagccacaggaaattaaggtatattatgctgccaagttaaacagtctaacaataagtagcaatatattttaggaggaggagaatatccttgaataagagggcaaaattacaaggtttccctttctgttcattcattcttgcaggcatgcaatacacatttggctcctgcatgtcaggcactgtgttaagtgccagggagaaataatgaaaaacaactgcaacaaccagacactgtccctgtccttacgtagtctatcaagggggcaggggcagggatttagccattaaccaaatagaatacaaataaatgtgtaattaaaaacaataaatgtgcatttgtgtgatggagtgagtggcaaggtaggaaaagtattttttaaaaaatcaatgtgtctctattttactttactttttttttttttggagacagggtctcattttgtcacccaagctggagtgaagtggtgtgacctcagctcattgcagcctcaacctcctgagttcaagcaatcctcctgcctcagcccccaagtagctgtgactacaagtgcgtgccaacacacctgactaatttttttgtattttttgtagagacgaggttttaccatgttgctcaggctggtcttgaactcctgagctcaagtgatctgcctgcctcagcctcccgaagtgctaggattccaggcatgagctaccatgcctggcctgtgtctctactttttaaaatcataacatttagctttgttatattcagcaaaatataaaaactccaattttcagatatattcttattatatattttaggaaaataaaaaacattttcataaacttaggaagtacttattgaaagaatactttttaatttcaaaagaattgcttttaaaactgagatttaaaaaggttacattggctgggcccagtgggttatgctcataatcccagaactttaggaggctgaggcaggaagatcacttgaacctaagagttcaagaccagcctgggcaacatagcaagacctcttctctacaaaaaaatcagaaaaaaaagaccaggcgcagtggctcatgcctgtgatcccagcactttgggaggctgaggcgggtggatcacttgaggtcaggagtttgagactagcctggccaacgtggtgagaccccatctctactaaaaatacaaaaattagctgggtgtggtagtgtgcacctgtataatcccagctactcagaaggctgaggcaggagaatcgcttgaacctgggaggtggaggttgcagtgagccgagatcatgccactgcactccagcctgggcaacagagtgagactctgtctcaaaaaaaaaaacaataaaaaagcagttgggtgtggtggcaggtgcctgtgatcctagctactcaggaggctgatgtgagagaattgtttgcgcccaggaggttgaggctgcagtgagctgtgatcatgcgactgcactccagtctgggtgacagagtgagacctggtctcaaaatgaaaataaaaataaaaatagaaaaagattacattaaggttctttgtttttgtttatttatttatttatttatttatttttttgagatggagtcactctgtcgcccagactggaatacagtggtgccatctcagcttactgcaacctccgcctcctgggttcaagcgattctcccatctcagcctcctgagtagccaggactggttacgttaattttaatgaatagttatgatcaatcaaacatttaaaaagtaaggataatagctcatattttgtgactagagtaacatttttcattttaaattttaaaagcatcaaaatgaaagcattaagcaacaggcttaatatgttcttacctgtactgtagctttgggcatccatgctaaagcaataaatattttctccttaaaactaaaaccagcaaagcacatcaatagatatgtggttaaaattcgaacacataatgccaaacttagagtggcaacagatatgcctacaacagatgaaaacaaacataaataacaaaatatttgtgaagaagtgttcttcatgcccaggaatatgatttctaaaacttttgaaaacattttaaggctattgtctcttcatgtgcttattttttacataaaaacaatgattataaaaaatgaatatgatggaggattctctgtaaagtgcaagagagtatctgatggtggaagtaccatgaaaaataagacagatgacatttatacaattctgaactaatagacttcttttgaatacttttattattaataataataatttattttttgagaaggattcttgctctgtcacccaggctggagtgcagtggtacaatctcaactcactgcaacttccgactcccgggttcacgcgattctcctgcctcagcctcccgagtagctgggattacagacgcgcactaccacacctggctaatttttgtatttttaggagagagggggttccccatgttagccaggcaggtctcgaactcctaacttcaagaaatctgcccgcttcggcctcccaaagtaagattacagacatgagccaccacgcccagccaatagttttaaatgaaagtactcaaaaagcgctgatcgtatcaaatatgttccctcaggaaagaaatcttatatttatttcttcagataactcagggaatatattcagggctgtccttggtttataaaaaaaaaagagcacccagtgtaaaggaagagcaatatgaaaatatgacactgtatcaacatgtgtttctgaagaaggtcgttgtagccaaagatatattgtaaataaaaataaatgtatttataattttcttaaatatttttgaatttcatattttttgtgctctaattattcttaccaacaatatttgattcaagcgatgaaacagatacttctgctccaactaaaccaaaaagaagtggttgaaaaatatcccatacagtcgtaataatcttttggactttcatctatagaaaagagaaatacatttataatgattttggcacataaatatatttcagaaacttaaagtcttccccccccttttttttttcattttttaagtattttagagatggggtcttgctctgttgcccaggctggagtgtagtggcataatcatagctcactgtagccttgaactcctgggctcaagtgatcctctcgcagtctcccaagtagaactacaggtgtgtaccaccatgctgggctaatttttaaattgtttatagagatggagtcttgctatgttgcccaggatggtctagaactcctgtcctcaagtggtctctggctgtggcgtcccaaagcactggcattataggcatgagccaccatgcctggcctaaagtcatttaacatttaataaatttaagacactttattttaataaaaatgttaaacttaataaaaactgagcacttcaatagttttattcaaacacttaggtagaatttgattaaaataaactcacaaagcaataaaataatactatttggccattttgtcacagaataagtgatgtccttagggttctagccatgtttcgtatgagttccagattttgtctgtaaagtaactgaacagagatataactacatcatgcctgatgagaacatacccagttcatgcaaacatttgggttctcaaaagggggttgggaagccctccactaacaaccatcctggaactcaatcccattaaagtgaatcctgatatatatagcatatactactaggaaaaacaatttggaagtctgctaggcctgcttccaaagaacccatgttgaatattttaaagttactttttccttaaaacaaaaccaaaacatatattagattctcatttaactgcctacccagcttccctttctggaaacgaatgcctcccagtgctacttccccaattaaaacgttacaggaaaggcccctattggcctacattactctggctcttctccaggaatttggatgaagagatttcagtctcagtctgggtttaacatttttttttttaaacagaagatacataagaactttgatgtctcttccttgaggcataaactatcttcataactatttcccttatgactgtgttttctgatccccacttattatagtttaaaaaaagaaaaacaaagaaaaacaatgttactattctttacagcataattatcctatttgttacttttaatctttaaaacttgttttagttctgtttcttttaccatttaaaaaaattctagcagttttaattttatttattgatttgcatttcattcatttcatttcttttatcattatgattatataagaatactaaacaaaatgtcactatgatttttggttggggaacttctcaagctgattctaaaatttatctaagaaagaatatgtgtaggaacagccaaaaaatactttaaaaagaagtataatctatattagattttgacacataaaactgcagtgatttaaaacagtggtgttggcatagaaatagagaagtaggattaaatagacttcagaattaatatatatgggagaatttagttcatgttaaaaaactgaattattaatgaattggtcaataaataaacaatttggcaaaaaatgactgtctagtttatgtgcatatatctgtatgtacatattcatcacatgcaagtacatatgtgtgtctgaatatatatgtatatttatgtgtgtgtgtatagatatatatatatacatacacacacatcaggcatgatgtagttctatctctgttcagttaacttacaaactgtatgtgtgtgtgtatatatataaatagtttgtaagatacacatatgtatatatgtataaccttacctcacagcattcacaaagataaattccagatagattaaaagactaaatgaaaaaaacaaattaaacaaacaaaaactaccaaaatattaaatgataatatacaaaatagtatatctttgtaacgtttatatgttataatcttcagtgagaaagtccttcttaaatgagatgcagaatccaaaaccaaaaaaggaaaacccaataggtttggtcataggaaattttactttcatacaccagacaccataaacaaagttgaagataagcaaaaattatatgcaatatatacataacaaaggatcagtagccctaagagaaactataaattagaaacaaaaaaataaataacccaataaaaatggtcaaagaagatcataggtattttaaaaagaatatatgaagagaagcttactatactactaatcagagaaatgtaaataaagaataacaacatcacataattgtaagaaactacaagaattggatggtgaggtcatctaatagtaaaaagaatagaactagtgataatatcaagtgctgttgatgagttaaggaattagatatttttgtgcactgttggcagagtgtaaataaccaaaatcttttgaagggataatttagcagtgtccatcaaaataaaacacagatcatttccagctaggtgtggtagctcatgcttgtaatcctagcactttgcgatgtcaagttgggaggatcccttcagctcaggattttaagaccagcctgggcaacatagagagactctgtctcaaaaaaaaaaaaagtcatttctaggactctatccctatagatgtacctgcaatcccaacattttgggaggccgaggcaggagtatcacctgaggtcaggagtttaagacctgcctggccaacatggtgaaaccccgtctctactaaaaatacaaaaatttgctgggtgtggtggtgtgcgcctgtaatcccagctactagggaggctgaaacagaagaatcacttgaatccaggaggtggagtttgcagtgagccaagattatgctactgcactccagcctgggtgacaagagtgaaactgtgtctcaaaaaaaaagacatgaacaacactgtttatgacagcactgtttgtaaataacaaaaagtggaaacgatcttaatgtctataaatagaatactggttacttaaaaaaatgtaagggggtttgatatttgacagtggtggggaataaagaaatcttttacattttattctatatgttttattcttttacaagcatttctatttttattatttgtttgtttattatttatttatttttttgtgatggagttttgcacttgttgcccaggctggagtgcaatggcatgatcttggctcctgggttcaagtgatgctcctgcctcagcctcctgagtagctgggattacaggtgcccaccaccacaccaccatgcccagctaatttttgtatttttagtagagatggggtttcaccatgttggccacactggtctcaaactcctgaccccacgcgatctgtccgcctccacctcccaaagttctgggattacaggcatgagccaccgtccccggccttttacaaacatttttcatggattaattgtataattaaaatttcaatgaataaaataattagattgataaaggtaatataataatattatataaaacttgggaaaaagagaagcctgatgtgattaactcaacttctgattccatattagtatatttccaggtgcttttcctaaatattttctttcctcgattgattcatacactttcttgaggacagaaaaccttttggaacattttccaaccagaatgaggggatttcctaaatatatgtaaaaaattcagttgttttagcttttaaaatatagcatattaaaaatattcaccttttcttgggaccattttgtccctgcaatgaaactcaacactagtgtgcataatcctccagatccatgtaaaccaatacgttggctgcctaagacggcagaaacacacatagtcaaaacaaggaatcctctcttcaatgtaagttttttctagaattagatagatatttagaaattagtttatattaaatatataatataagatttgacattatctattatatatttttgaccctctgatattatgtctttaaatgttatattaaatgtctaaaattttgattttctttctcaccatatattttagcagacttactaccaagtaacaaaatttgcaattagtcacgtttcatcttctgccatatctctgatactagtatcagtaatatggttaaagtattactataagtgaagaagaaaagagacccataaaatctccagtttcatataacatatccaatgaattcttaaaaaatatttgaatatctctttggtcaatatgttacagctaaatttggatggaaattacagaaatacaaaagtaatggcatgttttcctttaaggcaggaaatggctaaatttgagtgttgcctttgtcaaaggagagcaggagtgaatttcagtcagaaaatatgcagaaataaatggggacctatttccccctaaaatgtttaagggaaaatttgggggaaattatcaaacatcagtaggcagtttagtagagaaagggaaagtataattcagagggatactctgcattaagtatattttttgatattccttatttgccaaattaagaagcagagactttaatcaaagccattgacctgtatcaatcactgctgtgctcagttttaagtacagagtaggcattggaggctagttttagagaaatagaattaagtattaaatttcatcgaccttaccaaagtttaatattttgaaaaaaatgtctaatactatacttctataaaatagattttgtatttacctggtcttcacttggaaaatatcgaacaaaaaatcccaaaacaattcctgccagcagactaatacatacgttccttatagaggctatggcgttattaagtataccacctgtaggggcacacaataaaaaaaaattcacaaagaagtatcttcacatacactacacatcagaaaagcaaatctaggtggttcatgaagaaaagtaagcattttatagaacaaatatatgcaaatggtctttttatagtgacatatatgaaaacatgtagatctatttagtacgttaaatatatactctcaaataatttaatatatacacacaactcagaaatgtccattatgtaaataggccagaaaacaaagacttaacaagcacaagatgctccccttacatagccaacttaaaagacagagtgaggtagtccaggcacagtggctcacgcctgtaatcccagtgctttgggaggctgaggagggtggattacttgaggtcaggagttcaagaccagcctggccaacataatgaaaccccatctctactaaaaatacaaaaattagctgggcatggtggcacacacctgtggtcccaggtactcgggaggctgagggaggagaatcacttgaacccgggaggcagagtttgcagtgagctgagatcgtgacaccacactccagcctgggtgaaagacggaggccacacctccaaaagaaaaaaaaaaaaagactaagtgaggtacaagaatggagagagaccgaaacacttgtggcacttagcatatggctgttaagggctatattaacaattcttctttcatgtactatatgaaaaagaaacaaatgattttaacatgaaaagaacaatgtaataacaacataaaaaattttgttccagggtcagtcctagaaacattcaagggtcaattaagatttcagtatatttaagtatctgcttttggtgaagaaaaaaggaaaaaaaatacaaaagattccagtatattttatattcattaatattaatatatccatacttgtagttcattgtaataagtaaaaaacaaaaaataaaaaaacaaaatgagtcacaaaaatagttcagttaagctctgggtagtggattcaatatagtaagtaagtatatttttagacatattttctactaaatataacaggcagggcatggtgggctcacacctttaatcctagcactttgggaggccaaggcagaaggattgcttgagcccaagagtttgagaccagcttgggcaacagagtgaaaccccatctttacaagaaaataaaaaactagcccggtatgtggtgtgtgcctatagtccaagtactcagtaggctgagggaggaggtcccttgagctcaggagtttgaggctgcactccagcctggctgacagagcaagatcctgtctcaagaaaataaaatacaataaaaataaaaaataatataaacagagagatgtcagccagatggtggaatggggagctccaaaccttgattctccataaagataccaactgaacaacaatatatggtctaaaagcctttatggagttccataaaccattaagaagctgtagtagcacagacaagtgcaaagccaagaatagtggcattgaacaaataagaaaagctgttgcattatactcatgataccccttccccaagctggaacaggttggtgtggctgggaagcactcaacttgcagcttctccattagcagggaaagagaagactggaacggaatagttttatgaggttacctgaagctctctctctctctctaacttgacacccaactggcatactttggatgcgtgggagccactgggaataaaggagaggtcagagatgatgcagcaccagggaacctgcagtgccacagacagataccagagagaacaacagctccagaaaaagaaactggcaaacctctacttgggatgttgcaatgtataaacccaaagaagatgcattcccagaaaaggtttgagaggctgctagaacctatagccatgctgattcaggtaaaggtcttccgtatgaagccagctgataaaaactgggagcagtggcagttttttcaaacgtccaaatcttggcaaaaataagtaaaaaataaaaaaataaaaaataacaggcataagaagaaacagagaaacctgatgactaaattaaaggagcaaaataaatctccagaaaccaatcctaaagaaatagataaatgagttacctgacaaagaatccaaattaactctcttaatgaagcccagtgacaacagaaatagataactaaatgaaagcaggaaataattcatgaacaaaatgaaaatattaacaaagagatagaaactaaaaaaaaaaaaaaaaaaaaaggaaccatacagaaactctgaagctaaggaatacaacagctcaattgaaaaattcactattggaaatcaccaacagactgtgtaactgcccaatgggttcaccttgtgccctgcttagacagagctgatttatcaagacaggggaattgcaatggagaaagagtaattcatccagagccagctgtgcgggagaccagagttttattattactaaaatcagtctccctgagcattcggggatcagaagttttaaagataatttggcaggtaggggcttgggaagtggggactgctgattcatcaggttggagatgaaatcatagggggttgaagtgatgttttcttgctgtcttctgtttgtgggtgggatggcagaactagttgagccattattaccagtctgggtgcactggatgaatcagccagtgcagggtctgcaaaatatctcaagcaatgattttaggttttacaatagtgatgttatccccaggagcaatttggagaggttcagactcttggagccagaggctgcataacccttcaactgtaatttctaatgctatagctaatttgtttatcctgcaaaggcagactggttccaggcaagaaggggatcttttcaggaaatggctattatcaactttgtttcagagtcaaaccatgaactgaataccttcccaaaattagttcatccgactgccaggaatgaacaaggacagtttaaatgctagaagcaagatggagttgattaggtctgatgtctttcactgtcataatttcttcagttgtaatttttgcaaaggcagtttcaataacatcaagcagaataaagaatcagtgaaacagaagactagtcatttgaaattatggagtcagaggagcaaaagggaaaaggaatgaagagtgaagacagcctaagagacttataggatgccatcaagcagaccaatgtatgtattatgaaagtgccagaagaagagaaaaataaaggggcagagagccagttaaaaaaatgaccaaaaacttctcaaatttaaagaaggaaatggacatacaaatccaagagtctcaaagaactccaagttggataatttgcaaaagacctacaatgagacacattacaatcaaactgtcaaaagtcaaagacaaagagagaattttgaaaggaacaggatcaaagcaacttttcacatacaagggagatgccatatggttatcagtggaattctcagcaaaaactctacaggccagaagagaatgggatgatatattaaaagggctgaaagaaaaaaaaaaaactgtcaaccaagaactgtatagccagtaaaactgtacttcaaaaatgaaggacaaacaaagagttccccagagaattaaaaggtgagggaattgatcaccactagacctaccttacaaaaaatgttaaagggagtcctccatgtggaaatgaaagggcattggatagaaatacaaaagcatacaaaacataaacttctttggtaaaggtaaatatatgagtgaacatagaatcctttaatactgtaatggtggtaagtaaaacactttttttctttacttttttctttttcttttttgagacaaagtcttgctctgttgcccaggctggagtgcagtggtttgatcacagctcactgcagccttgcaggcctgggctaaagcaatcctcccacctcaacctcccaagtggctgggactacagacatgcaccaccacactcagataatatttttaaatttttagcagagataaggtcttgctggtctcaaactcctaggctcaagtggtcctcccattttggcctctcaaagtgctgggactacaggtgtaagacaccacacccagcctgtaattcacttttaattgaagcatagaatttaaaaagtaaaagcataacattactgtattaaattatgtgaataaacaatataaaaatatatattgtgtgacactgataacaaagtgagaaggaagtgtaaagaagtagagtttttgtatgtgattaaagttaagttgttgtcaatttaaaatagattattataactatgagatgttttcatgtaattctacagtaaccacaaagaaaagacctacagaagatacacaaataaacatgagaaaggaacccaagcatgcccctaccaaaaaaagaaatcagtgaaacataaagggaggcaggaagagaggaaaagtggaaaaaaatagctgcaagacatacataaaacaataaacaaaatgacaatagtaagcccctccctatcagtaactactttaaatgcaaataggctaattttccaatcaaaagacagagattggccaaatggatttaaaaaaatctaaatatatactatatgcaagagacttacattagatctaaagacacacaaaggttgaaagtgaaaggatggaaaaagatattcaatgcagttggtaaccaaaagagaacaacgatggccatacttagacaaaatagagtttaagtcaaataatagcacaagagacaaggatattacataataataaaagggccaattgaccaagaagatatagcaattataaatatatatgcaactaacagtacagcatctaaatatatgaagccaacatagacagaattgaggggtaacatagataacaacatcataataacagaaaacttcaatatcccactttcaattatggatacaataaccagacagaagatcaactggaaaacagagaacttgaacaacactgtagaccaattggacctatctgacatatacagaacacttcacccaataatagcaaaatacactttcttctcaagtacataccaagacttttccaggataaatggcatgctagtccacaaacaagtttttaaaaatttaagaaaactgaactcataccaagtatcttttctgaccacattaaatgaaattagaaattcatagcagaaggaaaaaggaaaagtaataaatatgtggaaattacaaaaatatactctgttaaccaattggcctgtatggttaatattaattgtcaatttgattgagggatgcttagatgcctgatgaagcactgagtgagggtatatctgtgagggtgctgccacaggagaatgatggatgagttagtggactgagagagaaagacccatcctcactgtgggtaggcatcatgcaattggttgcaagtgtggctagaacaaaaaggcagaagaatgggaacattcagcttgcttggatttcttttttatgcactttctctctcttccagagcagtatgcctttttctcctcttgcccttgcacatcaaactctaggttcttttgcctttggaccctggaacttgcatcagcagccttttgggagctctcaggcctttggcctcagactagtggctgcactgtcagcttccctggttttgagactttcaaatttggactgagccatgtcactggcttccttgggagccatgctttaggcttctctcattttccggcttatagatggcctattgtgggactttgcctttgtaattatgtgagccaattctccttaataaattatatttcatatatatgtaaatatattctcttttatatgcatgtatctatatctatatctatatctatatctatatctatatctatatctatatctatatctatatctcctattggttctgaccctctggagaactctgattaatacatagtcaaagaataagtcacaaggaaaattagaaaatgtctcgagacaaataaaaatggaaacacaacattccaaagcttgtgggatgcagcaaaatgaatatgaagaggacagtttatatatctaactacctaccttaaaaaagaagaaagatctaaaataagcaacttagctttacacctcaagaaactggaaaaagaagaactcaatccaatgttagcaaaaggaaggaaataataaagtctagagcagaaggccgggtgcaatggctcacgactgtaatcccagcactttgggaggccgaggcaggcagatcacctgagatcaggagtttgagaccagcctgagcaacatggagaaacctgtcactactaaaaaatacaaaattagccaggcatggtggtgcatgcctgtaatcccagctactctggaggctgaggcaggagagtcacttgaaccgggaggcagaggctgcactgagctgagatcgtgccactgcactccagcctgggcaataagagcaaaactccatctcaaaaaaaaaaaaaaaaaaaaggctagagaaaaaaaaaacccaatgaaactagtagttgtttcaaagttcaacaaaattgacaaataatcagctagaatatttaagaaaaaaaataaagaagactcaacttcttttaggaacaaaagagaagacattgcaacagatattacagaaataaaaaggattctaagagtctactatgaatgattatatactgacaagttggataacctaggagaaatgaacagattcctagtaacatgcaagttaccaagactaagtcacaaaataaaaaatcttaatagacctataactagtaactgaatcaggaatcaaaaacctcccagcaaaccaaatacctgataaggggttaatatctaaaatatatacagaacaacaactcaataacaaaacaacataatgagaaacggtcagttgactttgctatggtccaaatgtttatgttctcccaatattcatatgctggagcctaatattcaatgtgataatattaagaggtggggcattttggagatgattagttcatgaagtcatagccctcagaaatgggactagggcctttataaaagaggcttaagggagtttactttcccttttgaacatgtgaggacaaagagaaggtgctatctatagtgaatatagtgacctcaccagtcactgagtctgttgtagcctaaatcttggacttctcacattccagaacgcaagaaataaatttctgttgttcataaattaccagcctaaggtattttgttatagcagcaggaatggactaagatagacttgaacagacattttttccaaaaaaaaatacaaatggccaactagcatatcaacccgacactatgtggcagctgccaaggcttggggattgaactctctgaagcaatagcctgagctgtatgttggctccttttagccatggctgggacatagtgcagtcccaagactgcacagagcagcaaagctctgggcctggcccacaaaaccattttttccctcctaggcctccaaccctgtgacgggaggggctgttgtgaagaactctgacataccctggagacaatttccccattatcttggcaattaacattcggctccttgttacttctgcaaatttctgcagtcagcttgaatttctccccagaaaatgggcttttcttttctatcacatcataaggctgcaaatcttccaaacttttatgctctgtctcccttttaaacataagttccaattccaaaccatatttttgtgaatgcataaaactgaacacttttaagagcactcaggtcataaactgaacactctgctgcttagaaatttcttctaccagatgtcctgggtgggttccaagatggccaaataggaacagttccggtctgcagctcccagcatgatcgacgcagaagacaggtgatttctgcacttccaactgaggtacctggttcatctcattgggactggttggagagtgggtgcaggcccacagagggtgagctgaagcagggtggggcatcacctcacccgggaagcacaaggggttgggggatttccctttcctagccaagggaagccgtgacagactacctggaaaaacagggcactcctgcccaaatactgcacttttcccaaggtcttagcaactagcagacaagatgattctctcccgtgcctggctcagcgggtcccacacccatggagccttgctcactactagcgcaacagtctgagatccatctgcgaggtggcagcctggctgggggagggccgtccaccattgctgaggcttaagtaggtaaacaaagcggctgggaagcttgaactgggtggagcccactgcagctcaacaaggcctattgcctctagactccacctctgtgggcagggatagctgaacaaaaggcagcaacttctgcaaacttaaacgtccctgtctgacagctctgaagagagcagtggttttcccagcatggcgtttgagttctgagaatggacagactgcctcatcaagtgggtccctgacccctgtgtagcctaactgggacacacctgccagtaggggctgacagacacctcatttaggcggatgcccctcttggacgaagcttccagaggaaggatcgggcagcaatatttgctgttctgcagcctccactggtgatactcaggcaaacagggtctggagtggaactccagcaaactccaacagacttgcagctgagggtcctgactgttagaaggaaaactaacaaacagaaaggaatagcatcaacattaaccaaaagatcatctacaccaaaaccccatctgtaggtcaacaatgtcaaagaacaaaggtagataaaaccaaaaggatagggataaaccagagcagaaaagctgaaaattctaaaaatcagagcacctcttctcctccaaaggatcgcagctccttgtcagcaatggaacaaagctggatggagaatgactttgacgagttgacagaagtaggcttcagaaggttggtaataacaaacttctccgagctaaaggaggatgttggaacccatcgcaaggaaggtaaaaaccttgaaaaaagattagatgaatggcttacaagaataaacagtgtagagaagaccttaagtgacctgatggagctgaaaaccttggcacgagaactttgtgacacatgcacaagcttcaatagccgattcaatcaagtggaagaaagggtatcagtgattgaagatcaaataaatgaaataaagtgagaagacaaggttagagaaacaagagtaaaaagaaatgaagaaagcctccaagaaatatgggactatgtgaaaagaccaaatctacatttgattggtgtacctgaaagtgatgaggagaatggaaccaagttggaaaacactcttcaggatattatccaggagaacttccccaacctagcaaggcaggccaacattcaaattcaggaaatacagagaacaccacaaaaatactccttgagaagagcaattccaagaaacatacttatcagattcaccaaggttgaaatgaaggaaaaagtgttaagggcacccagagagaaaggtcaggttagccagaaagggaagcccatcagactaacagtggatctctcagcagaaaccctgcaagccagaagtaagtaggggccaatattcaacactcttaaagaaaagaattttcaactcagaatttcatatccagccaaactaagcttcataagtgaaggagaaataaaatcctttacagacaagcaaatgctgagagattttgtcaccaccaggcctgccttacaagagctcctgaaggaagcactaaacatggaaagaaacacccggtaccagccagggcaaaaacaggccaaactgtaaagaccatcaatgctaggaagaaactgcatcaattaacgggcaaataaccagcaactatcataataacaggatcaaattcacacataacaatattaaccataaacgtaaatgggctaaatgccccaattaaaagacacagactggcaaactggataaagagtcaagacccatcagtgtgctgtattcaggagacccatctaacgtgcagagacacacataggctcaaaataaagggatggaggaagatctaccaaacaaatggaaagcaaaaaatagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaagagcacccagattcataaagcaggtccttagagacttacaaagagacttagactcccacacaataataatgggagaatttcacaccccactgtcaatattagaaagatcaagaagacagaaggttaacaaagatatccaggacctgaactcagctctgcaacaaacagacctaatagatatctacagaactctccaccccaaatcaacagagtatacattcttctcagcaccacatcacacttattctaaaattgaccacataattggaagtaaagcactagtcagcaaatgtaaaagaacagaaatcacaacaaactgtctctcagaccacagtgcaatcaaattagaacttaggattaagaagctccctcaaaactgaacaactacatggaactgaacaatttgctcctgaatgactactgggtaaataacaaaatgaaggcagaaataaagatgttctttgaaaccaatgagaacaaaggcacaatgtaccagaatctctgggacacatttaaagcagtgtgtagagggaaatttatagcactaaatgcccagaagagaaagcaggaaagatctaaaattgacaccttaacatcacaattaaaagaactagagaagcaagagcaaacacattcaaaagccagcagaaggcaaaaaataagatcagagcagagctgaaggagatacagacacaaaaaacccttcaaaaagtcaatgaatccaggagctggttttttgaaaagatcaacaaaattgacagactgctagcaagcctaataaagaagaaaagagagaggaatcaaatagatgcaataaaaatgataaaggggatatcaccactgagcccatggaaatacaaactaccatcagagaatactataaacacctctatgcaaataaactacaacatctagaagaaatggataaattctgggacacatacacccttccaagactaaaccaggaagaagttgaatctctgaatagaccaataacaggctctgaaattgaggcaataattaatagcctaccaaccaaaaaaaaagtccaggaccagatggattcacagctgaattctaccagaggcacaaagaggagctggtaccattctttctgaaactattccaatcaatagaaaaagagagaatcctccctaattcattttatgaggccaacatcatcctgataccaaagcctggcagggacacaacaacaacaaaaaagggaattttagaccaatatccctatgaacattgatacaaaaatcctcaataagatactgacaaactgaatccagcagcacatcaaaaagcttatccaccacgatcaagttggcttcatccctgggatgcaaggctggttcaacatacacaaatcaataaatgtaatccatcatataagcagaaccaaagacaaaaaccacatgattatcttaatagatgcagaaaaggcctttgacaaaattcaacagcccttcatgctaagaactctcaataaactaggtattgatgggacgtatcttaaaataataagagctatttatgacaaacccacagccaatatcatactgaatggacaataactggaagcattccctttgaaaactggcacaatacaaggatgctctctctcatcactcctattcaacatagtcttggaagttctggccagggcaatcagggaagagaatgaaataaagggtattcaattaggaaaagaggaagtcaaattgtccctgtttgcagatgacattattgtatatttagaaaaccccatcatctcagcccaaaatctccttaagctaagcaacttcagcaaagtctcaggatacaaaatcaacgtgtaaaaatcacaagcattcttatacaccaataacaaacagagagccaaatcatgagtgaactcccattcacaattgcttcaaagagaataaaatacctaggaatccaacttacaagggaaatgaaggacctcttcaaggagaactacaaaccacttctcaacgaaataaaagaggacacaaacaaatggaagaacattccatgctcatggataggaagaatcaatattgtgaaaatggccatattgccaaaggtaatttatagattcaatgccatccccatcaagctaccaatgactttcttcacagaattggaaaaaactactttcaagttcatatggaaccaaaaaagaacctgcattgccaagacagtcttaagccaaaagaacaaagctggaggcatcacactacctgacttcaaactacactacaaggctacagtaaccaaaacagcatggtactggtgccaaagcagagatatagaccaatggaacagaatagagccctcagaaataatacgacacatctacaaccatctgatctttgacaaacctgacataaacgagaaatggggaaaggattccctatttaataaatggtgctgggaaaacgggctagcaatacgtagaaaactgaaactggatcccttccttacactttatataaaaattaattcaagatggattaaagacttacatgttagacctaaaaccataaaaaccctagaagaatacctaggcaataccattcaggccataggcatgggcaaagaattaatgactaaaacaccaatagcaatggcaacaaaagccaaaattgacaaatgggatctaattaaactagagagcttctgcacagcaaaagaaactaccatcagagtgaacagacaacctacagaatgggagaaaatttttacaatctacccatctgacaaagggctaatatccagaatctacaaataacttaaacaaatttatatgaaaaaatcaaaccccatcaaaaagtaggcaaaggatatgaacagacacttctcaaaagaagacatctatgcagccaacagacacatgaaaaaatgctcatcatcactggccatcagagaaatgcaaatcaaaaccacaatgagataccatctcacaccaattagaatggtgatcattaaaaagtcaggaaacaacaggtgctggagaggttatggagaaataggaatgcttttacactgttggtgggagtgtaaactagttcaatcattgtagaagacagtgtggcgattcctcaaggatctagaactagaaataccatttcacccagccatcccattactggtcatatacccaaaggattatgaatcatgctgctataaagacacatgcacacgtatgtttattgtggcactattcacaatagtaaagacttggaaccaacccaaatgcccatcaatgatagactggattaagaaaatgtggcacatatacaccatggaatactatgcagccataaaaaggatgagttcctgtcctttataaggacatggatgaagctagaaaccatcattctgagaaaactatcacaaggacagaaaaccaaacaccgcatgttctcactcataggtgggaattgaacaatgagaacacttggacacagggtggggaacatcacacactggggcctgtcatggagtgtggggagggaggggatagcattaggagatatatctaatgtaaatgacgagttaatgggtgcagcacaccaatatggcacatgtatgcatatgtaacaaacctgcatgttgtgcacatgtaccctagaacttaaagtataataacaaaaaaaactatgacactgtcctatataccatatctgtacaaaaattataaattttagatagccatccagagatacttctctacttcttggaaaaaatatcaacattgaaaacatcaaaaaaattaaacacttcttcttttgtccaaaaaaaaaaagaaagaaaaaagggaatcctccctaactcattttatgaggccagcatcatcctggtaccaaagcctggcagagacacaacaaaaaaagagaattttagaccaatatccctgatgaacatcgatgcaaaaatcctcaataaaatactggcaaaccgaatccagcagcacatcaaaaagcttatccaccacgatcaagtcggcttcatctctgggatgcaaggctggttcaacatatgtaactcaataaacataatccattacataaacagaaccaaagacaaaaaccacatgattatctcaatagatgcagaaaaggcctttgacaaaattcaacactccttcatgctaaaaactctcaataaactaggtattgatgggacgtatctcaaaataataagagctatttatgacaaacccacagccaatatcatactgaatgggcaaaaactggaagcattccttttgaaaaccggcacaagacaaggatgccctctctcaccactcctattcaacatggtgttggaagttctgaccagtgcaatcaggcaggagaaagaaataaatggtattcagttaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccattaatagacaaacagagagccaaatcatgagtgaactcccattcacaattgctacaaagagaataaaatacctaggaatccaacttacaagggttgtgaaggacctcttcaaggagaactacaaaccactgctcaacgaaataaaagaggacacaaacaaattgaagaatattccatgctcatggataggaagaatcaatatcatggaaatggccatactgcccgaagtaatttatagattcaatactatccccatcaagctactaatgactttcttcacagaattggaaaaaaaactgctttaaagttcatatggaaccaaaaaagagcctgcattgccaagacaatcctaagcaaaaagaacaaagctggaggcatcacactacctgacttcaaactgtactacaaggctgcactaaccaaaacagcatggtactggtaccaaaacagatatatagaccaatggaacagaacagaggcctcagaaataagaccacacatctacagccatctgatctttgacaaaactgagaaaaacaagaaatggggaaaggattgcctatttaataaatgatgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggccataggcatgggcgaggtcttcatgactaaaacaccaatagtaatggcaacagaagccaaaattgagaaatggaatctaactaaactaaagagcttctgcatagcaaaagaaactgccatcagagtgaaccaggcaacctacagaatgggagacaaattgcgatctacccatttgacaaagaaagaattcaaacaaatttacaagaaaaaaacaataccatcaaaaagtgggcaaagatatgaatagacacttctccaaagtagacatctatgcagctaacagacacatgaaaaaatgctcatcatcactggtcatcagagaaatgcaaatcaaaaccacaatgagatatcatctcatgccagttagaatggcaatcattaaaaagtcaggaaacaacagatgctggagagcatatggagaaataggaacacttttacactgttgatgggagtgtaaattagttcaaccattgtggaagacattgtggcgattcctcgaggatatagaactagaattaccatttgacccggcaatcccattactgggtatatacccaaaggattttaaatcatgctactataaagacacatgcacatgtatgtttatttcggcactattcacaatagcaaagacttgtaaccaacccaaatgtccatcaatgatggactggattaagacacgtgacacatatacaccatggaatactaatgcaatcataaaaaaggatgagttcatgtcctttgcagggagatagatgaagctggaaaccatcactctcagcaaaactatcacaaggacagaaaaccaaacaccgcatgttctcactcataggtgggaattgaacaatgagatcacttggacacagggctgggaacatcacacactggggcctgtcggggggtggagggctgggggagggagagcattaggagaaatacctaatgtaaatgatgagttgatgggtgcagcaaaccaacacggcacatgtatacctatgtatcaaacctgcatgttgtgcacctgtaccctagaacttaaggtataacaacaccaacaaaaaaagaagtttcttctaccagatgtcctcaatcatctctctcagtttcaaagttccataaatctctagggcaggggcaaaatgccaccagcctctttgctaaagcatagcaagagtgacctttacttcagttcccaacaagttctttatctccatctcagacctcctcagcctggacttcactgtccaagtcactatcagcagttcggtcaaagccattcaacaagtctctaggcagttccaaactttcccacatcttctggtcttcttctgagtcctcccaactgttccaccctctgcacattacacagctccaaagtcacttccacattctcaggtattttatagcattactccattaccttggtatcaaaatctgtattagtcatggttctctagagggatagaactaataggatatatgtatgtatgaaagggagtttattaaggagaattgaatcacaccatcacaaagtgaagtcccacaacacgtctgcaagttgaggggcaaggaatctagtattggctcagtccgagtcccaaaacctcaaaagtagggaaactgacaggccagctttgagtctctggatgaaggcctgagagtccctggaaaacaactggagtaagtccaagagtccaaaagccaaagaacctggagtctgatatttgagtgcaggaagcatccagcatgggagaaagatgagggccagaaagctcagcaagtcagcttctcctaaacttcttctgcctgctttattctagccatgctggcagctgattttatggtgccgacccacactgagggtggatctgcctctcccagtccactaaataaatgttaatctcctttggcaacaccctcacagacacaaccgggaacaatactttggatccttcaatccaatcaagttgacacttacttaatattaatcttcacaatgtaatattcatcccatttgtaatttttctttaatatacaagctccttgagaacatgcaccatttgatcttgtctctctgttttcttgggaggcagtggagaagagaagagttaaatgtgtgggtgtggagtcagactgccagatttgcatcttggctcccctacttactggatctctgaccttgagtaaattacttaacatctttctcagtttccttacctgtaaatgagtggtgacatatatggaacttagaacaagagccaagcaagtattcaataaaagctaatgttgttgcctactgtttattctcagtgtttggcatagtagccggcaaaaggaagaggaattttttttttctttttttcagacagtctccccctgtcacccaggctggagtgcagtggtgtgatcttggctcactgcaacctctgcctcttgggttcaagcaattcttgtgcctcagccccctgagtagctgggattacaggcctgtgccaccacacccagctaactttttgtatttttagtagagatggagctttgctatgttggccaggctggtcttgaactcatgtcctcaagtgatccacccactttggcctcccaaagtgttgggattataggcgtgagccattgggcccggcctggaaatatttttttgaaacatgactgataacagtattttttgaaagaatgacagataccaatcatgaaggaaaagattttcacaattgacaataaaaaactttaacttctgaatggtaaaaagagtgagaaaattaaaagccaaattacaaattgaaaaaactaaagtatataaaacaaaggttttcattctcaatttaatgcagaatcttgacaaatcaaaaagaacaaaaggtgaacccacctaaaagaaataggcaaaagacttccaagaaaagcaatttacaaaatgccaatgactaataaacatggatatttaacagcactagtattcaaaatacttcatttatagagatccctccttcacctatcaaattagcaaagatgaaaaaggctagtattaccaagttttgaagacaggtgagaggaaatgacaagtttatgtaccctggtaggacatgatattgtggcaatttgtttcagaacactcataaatgtagatatcttttagatcaacaattacacttttaagcttaagaaaatatgaagaataggtacaaatatttctctatatgttcaattaagtattattttttaaattaaaaaaaaattttttttgagacagtgtctcactctgttgcccaggctggatagctcactacggcctccgcctcctgggttcaagtgattcttctgcttcagcctcctgagtagctgggattacagatgcccaccaccatgcctggctaagttttgtatttttagtagagacagggtttcaccatgttggttggccaggctggtcttgaactcctgatctcaagtgatccacccttcttggcctcccaaagtgctgggattacaggcatgagccaccatgcctggccaattttttaattaaaaaaaatttttatagcagcacaactaagtattattttaatagtaaatattggagtcaagtttaattttgaacaggataagtaattatgatgcagcacattgaatactctttcattaagctaaacaactattaaaatgatatacaaatacatttactgaaaagaaacatgtttgtgatatacagttaagtgtaaaacaattcaggttataagaacatattaggccaggtgcgatgtctcacgcctgtaatcccagcactttgggaggccgaggcgggcggatcatgaggtcaggagattgagaccatcctggctaacatggtgaaaccctgtctctactaaaaatataaaaaaaattagccgggcgtggtggtgggtgcttatagtcccaactacttgggaggctgaggcaggagaatggcgtgaacccgggaggcagagcatgcagtgagccgagattgtgccactgcactccaacctgggtgacagagcaagactccgcctcaaaaaaaaaaaaaagaacatattggtcaatattcactgatttttataagaatatttgacagagagagagggggaagggaagggaaggggaaaggaaagggaaaggaagaagggaagaagggaagggaagggaatatgggtggatttatatcaaaaggttcagaaggaaatgattcttttcttctggatgtgactactgcagatttttttaacttttcctctttttcttatttatttatattttctgattttaagagaaactataaaactatatatattacttttcaacttaaaaatattttagtgcttcaataatgcagaagactcaatttcaacattgcagataattaaagcattactaaatgtggaaatgtttactttcacaatttctgtagtgatattcaagaccagatatcaccttggaatcagaactggtgcaggatcttgtcctaacactaccattaaggcatatggctgacccagctctgtatgtttaggttgtcttataatagagcaaccagttgtttattaggatggccaaaaaggcacatttcaaaaatgcctattaaaatattagtagtacaaataataccgctgaattttttctaatgagaactgataaaattccaaagcaatataagcagatacatagtaataatatggtttatcaaattaattgtcacatgattattaaaatgagatcatgtgtgttaagtagtggtatcttaagccactgaaatatcttccttggtctagaatgagctttctatggagattaaaaagatgttaaattgaacagtcttggttaataaatgaagaagcaaagccagaaaccctgtttaaagaagtaacaaaaaaggtcatgaatgatctagtggttgttatattttcttgtttacctgaggaaaagactatgctcaagcatgtattgaatccagtgatagccagaatgtcatccatactgctagcagccattaataaggttggaatgccttcctcaacaccatatccattttcttgcagcaccatcatgtaagggacaacaacagcaggagagacagcacctagaacaaaactgaaagaaagaatgaaaattaatttaaaagcatcttttaaatcaagtagtgttttataagtacaagtagtttataataactttataacaaacattgtttagaagaatttcaaatttgagtgaatgcaatttaatggtgataaaacttttcatgcattgtttagtgctggctaaaattttatacagatgtggtttaaaatgttgggctgaacacaggttgcagcctctccctctattcctaaatcctttgaagtgaagatgtaaaagtaatagaaaaattcataacctaaccagaaagcaaaaggtgaatccgcaatggacaagaaactaagtatatcccagtaagataagagacagacaatttaggattgaaaaaaggaaaccataaaccaaaatctgtgtaaataagattgcctcaaaagatacatgtgcttctaaaagtgctccaagccctgaaatggcagatgctgggagcaggagagacctctggggaaaccaaatagttaattatttggagtaccactgtaagaatggtcagacaaatctatcttccacacatttcctacctcttgagtaaataagtaagtaaggaaggaaggaacagagttgtctgcccaaaaaaacaagtgtggccacctaagttacaaaggcaaatgagaacatttctggagtggttgatgacacccatgaggaatggggaggctcctgctccgaataccttctattgacatatcttatccagaatttcgcctcatctcttctacatttactttataaaggctgaagtatatcctgtgtagaaatgcttttggtgctcctgccagaattgacctggtaaatgaacacatctcccagtgctgcttgttggctgctaatatctgcagatttctagaacccttgtcctgctgacaagcacctacctgggaatactagggaggttgtgcacccctctactttccctccagacagcatctgccaatgactgactgatgtgagtgtctaatagtttagcccatttgcttctggctgtacaacctctatggtgcagtttatgctacagatttccctgtgggctcaagaagagactagacttctctaagaccacatactggtctagttcagtggttcctaaactctgctgcacattgtaatcacctgttgtattatttttctcattttgcttaacaagtcatccccaaacatagcagcttaaaacaacaaatatttattgtcttatgacttctgtgggtcaggaatctgggcatggcttagctgtatgccttcacttaagatttcccatgaggtagggtggggtgggagaagatctgcttccaagtttactcatgtagctattgcaggcttcagttttttccaatggggttttctccacagggctgcctcaggacatggcagctggcttccccaggaataagtgatcaaagagaatttaatccataacatcaattaaaaacacaaaatatctaagaaaaaaactgtgaagatagtctatacttttataaaaattgtgaatataataatataataattaagataatacctgaatacttagagagacatttcacaagtgtgaactaaaaagcctcaattttaccatcgcccaacaccacgtctggctagtttttgtgtttttagtagatacggtgtttcaccattttggccaggctggtcttgaactcctgacttcaagtgatatgcccaccttggcctcccaaagtgctgggattataggtgtgagccaccatgcccggccaaagcctcaataatataaagatgtaatctctcccccaaataaattaatcagagatacaccaatcaaaatctttgcagggatttttactgagcttgacaagctgattataaaattcatttggaagaataagatcttagaacaaaagatcaagtaaacttaagaaaacaagatactgtttttgtaagggtaaaatagttaaaactgaataatagtgacatataaatagacaaaataaattggaagaaaagaaaatacaatgtgtggaaacaaatctatgggatttgttacatcatacaattggtattttaaatcagtgggagaaagaaagaaatctttcataaatggtgttgagataactatttatgtggaaaggaatatagatagatccttacacataataaatgttaaaagctcaaaaggaaaagtagtaataagaaaatgtagggggctaggtgcgatggctcacacctgtaatcccagcactttgggaggctgaggcggacagatcaggagtttgagaccagcctggccaacattgtgaaaccaatagctgggtgcagtggtgcatgcctgtagtcccagctacttggaaggttgaggcaggagaatcacttgaacccgggaggtggaggttgcagtgagctgagatcacgccactgcactacagcctgggtgacaggaagactctgtcacaaaaaaaaaaaaaaagaaaatgtagaataatatatttgtgatcatgaggtaaaaaggaccttttgaatgatacatacaaaggcattagacataaaaagagattttgatacattcaattatattaaagtagtacttcaaaagcaacttcaaaagtactacaataaagtactacttcaaaagcaattctgctctttctccccctttttttctttttcattttcaaagtcaagtgaatggtgttgtgtattggcaattctgtctgttgaaaataacaaaatacacttcttagagagaaaaaaaatcatcacaaacaaaattaaatatctagtgatatttgcaatacatataatttacaaatacatataacagatataattaataaagaagttgaagactcaacaaaaaaatggacaaaggatatgaacaggctagttacagataaggaaaagttgaaggacaacacatatataaaagatattcaagtttgtgaataatcacagaaatgcaaattaaaacaacaaaaatatgccattttttcaattatcagatgtgaaaacattataaaatttaataatatcaaggatttgcaaggattttcaagaacaacaggtatgctcataagctattggtattagggcaaattaaagtggccataccgaagggattttggcagtgtatatcaaactaaaaatgcatataacccaggtaactattctagacaaacttatatttaagtaaaatgagacaaataaaatgctatttttgttataacattgtaaataaaatctgctgttgacatacaatgtagtcttatacaattaaaaggaataaactacgtgtgtatccatcttgagatggataaacctcaagactattgttaagtgaaaagaacaaattgtaaagtaaaattttcttgggtatgattaagtaaaaatgcacaaaataatactcttttttttctctgggttcacaaatacacttgttagaagtccagaacattattttcaaagatctagaatggtaacataaaactcacgaagatgctgccactctgtccccagtggcacatgagtgcaccccacagcaccattgccctggctgacccatgcaagtatgcagaacaaccccatcccacacctgccggcactgcacccctgccaacacaggcatacctgctgtgtgctgctgctgctggcacatatgtgtgagtagggaccttgctacaatcactacaatgaagcactctggctggcacaccccatcagagtgttgttgccagtggactgggaacacctcagtgcttaacactgaagggccagacaacaaatctgtgggtatggtaccagccctgcaaagttagagcatgcagctcaggagtgctgagctgagcctttgccccctgaaatcttccagaaatgaagccatttgactgaacctaccttgtgccacagtcaaaccctcaagggcattaaagaatataaaaaaggaaaaagctccatccaaaggacagtgactcaaaacattaaaggaaccttagcccacacagatgtgaaagaaccagtgcaaaaactggcaatgtaaaaagccagaatgtcttcctgtcttcaagcaatcatactaactctctaacaatggttgttaaccaggattaaatgacagacatagaattcagaatctggatagaaacaaagatcattgagattcagaagaaagtcaaaatccaatccaaataatctaaggaatccaataagatgacataagagctgaaagatgaaataggcattttaagaaagaaccaaactaaactgatagagctgaaaaatgcgcctcaagaatttcataatacaataacaagtactaacagcagaacagaccaagctgagaaaagaatcttagatctcaaagaccacttctttgaattaactcagtcagatgaaaataaagaacaagaaagaatgaacaaaacctctgagaaatctgagattatgtaaagagaccaaacatatgactcaaggcatcactcaaagaaagggagaaagaataagcaagttggaaaacatatttgaggatactgcccacaaaaatttcccaaatcttgctagagaagtcaccatttaaatccaggaaatgcagagaacccctgtgagatactacataagatgaccatccccaagacatccccaagtcatcagattctccaaggtcaacatgaaagaaaaaaacatgaaaggcagctaaagtgaaggggcaggtcacctacaaagggaatcccatcaggctaacagtggaactgtaagatactctacaatccaaaagaaattgggggcctatattcagcattctttctttttgtttttgagatggagtctcactctgttgcccaggctagagtggactggtgctatcttggctcactgcaacctccacttcccgggttcaagcgattcttctgcctcagcctcccaagtagctgggactacaggtgcgcaccacaacacctggcaattttttgtaattttagtagagacgggatttcaccatattggccagggtggtctcaaattcccaacctcgtgatctgcccacctcggcctctcaaagtgctgggattacaggtatgagccaccatgcctggccttcagcattcttaaaaaaaaaaaaaaaaaaaaaaaaaaaaacttggctgggtgtggtggctcatgcctgtaatcccagcactttgggaggctgaggggggtggatcacaaggtcaagagatcaagaccatcctggccaacacggtgaaaccccatctctactaaaaatacaaaaattagctgggcatggtgatgcgtgtctgtagtcccagctactcgggaggctgaggcaggagaatcacttaacccaggaggtggaggttgcagtgagctgagatagcaccactgcactccagcctggcgacagagcaacactctgtcgccaaaaaaaaaaaaaaaaaaaaaattcaaccaagaacttaatatccagccaaactaaacttcatattgaaggagaagtaagatccttttcagacaaacaaatgctaagggaatctgttaccaccagacatgccttacaagaggtccttaaaggagtgctaagtgtggaagtgaaggactgttaatggccaccacaaaaatacgtttaagtacatagaacattgacattgtaaagtaactacacaatcaagtctgcataataaccagctaacaacataatgacaggaccaaagctataaatatcaatattaactgtgaatgtaaacagtataaacgccccacttaaaactcacagaatggcaagttggataaagaagcaaagcccaactgtatctgctgtcaagagacccagctcatatgcaacgatacccattggctcaaagtaaaaggatggaaaaaaatctagcaagcaaatgcaaaacaaaaaagggtaagcattgttatcctaattcagacaaaatagactttaaaccaacaacaatcaaaaagacaaagaagggcactacgtaatgataaagggttcaattcaacaagaagacttaactgtctaaaagataaatgtgctcaaaactggagcattcagattcataaaacaagttcatagagacctatagagaaacttagataaccacagaataatagtgggagacttcaacatctcactgacagtactagacagatcaaagagacagaaaatgaacaaagatattcaggacttgaagtcaacacttggctaaatggacctaacagccatctacagaacactccacccaacaacaacagaatatatgttcctctcatctgtacatggcatatattgtaaaattgatcacactatcagtctaaaattattttcaataaatttaagaaaacccctgaaatcaggccaaccacactcttggacccgcagtgtaataaaaatagaagtcaacactaagacgaactctcaaaaccatacaattacatggaaattaaacaacctgtgcctgaatgacttttgggtaaacaatgaaattaaggcagaaaccaataaattctttataactaattaaaacaaagatacaacattctcggctctctaagacacaggcaaagcagtgttaagggaaaagtttatagtgctaaatgcccatattgaaaagttagaaggatcttaaattaacaacctaatatcatacctaaaggaaacagaaaaacgagaggaaaccatcccaaagctagcagaagaaaagaaataaccaaaatcagagcagaatggaatgaaattgagtcatgaaaagccatacaaaagataaatgaaactaaaagctggttcttcgagagaataaataaattggataggtcactagctagaccaataaggaaaaaaaaaaaagagagagagaagatccaaaaaacacaatcagaaatggcaaagtggacgttaccgccaaccacacagaaatacaaaaaactctcagagactacgatgaacatcttcatgcaaacaaagtagaacacctatgagaaattggtaaatttctggaaacatacaacttcccaagattgaactaggaagaaactgaaatcctgaacaaatcaaaaatgagttctgaaactgaatgagtaataaaaagtctctgagccaaaaaaaaaaaaaaaaaaaaaagcaagcccaggacccaacagattcacagacaaattctaccagaagtgtaaagaagagctggtaccaatgctactgaaattattccaaaaaaatgaggaggaaggatccctccctaactcattttatgaggccagcatcattcagatatgaaaacctggcagagacacaacaaaaaagaaaacttcaggacagttatcactgatgatcatagatgcaaaaatcctcaacaaaatacaagccaactgaatccagcagcatatcaaaaagctagtccactatgattaagtaagctttatccctgggatgcaagtttggttcaagatatacaaaccaataaatgtgattcatcatataatagaactaaaaataaaaacatcccttcatgatatagaccctcaacaaatgagttactgaaggagcatacctcaaaataattggagccatttatgacaaaaccacagccaacttcatactgaatgggaaaaagctggaatactccctttgagaactggaacaagacaaggatgcccactctcactactcctattcaacatagtaatggatgtcctagccagtgcaattaggcaagagaaagaaacacagacatctaaataggaagaatggaagccaaactatgcctcttcataggtgaaacacttttataccaagaaaaccccatagtagcctctcaagagctcccagatctgacaaatgacttcagcaaagtttcaggttacaaaactcaatgtacaaaaatctgtagcatttctatacaccaacaacatccaagctgaaagccaaatcaagaatgcaatcccattcacaatagccacaaaaaaactataaaataccttggaatacagctaagcagggaggtgaaatatctctacaatgaaaattacaaacgagtgctcaaagaatcagagacaacagaaacaaaaggaaaacattccatgatcacagataggaagaagcaatattgttaaaatggccatactgcctaaggctatttacagagtcaatgctattcctatcatactatcaatgacatttttcacaggattaaaaaaagcatcctaaaattcatttggagccaaaaaaacaaacaaacaaaaaaagcccaaatagccaaagcaatcctaagcaaaaagaacaaagccaaaagcatcacactacctgacttcgaacggtagtacaatgctacagtaagcaaaacagcatggttatgctcagcaaaagaaataatcagcagagtaaaaagacaacctatagagtgggagaaaatctttacaaactatgcatccaacaaagtactaatatccagaatctataaggaactcaaaaacagacatagaccagtggaacaggttacagaacgcagaaataaagccgcacacctatagccatctactcttcaacaaacttgacaaaaacaagcaatggggaaaggaatccctactcggaaattgtgctgggataactggctagccatatgcagaaaactgaaactggactccatacgtttcaccgtttacaaaaatcacctcaagatagattaaagacttaaatgtaaaacccaaaactataaaaaccctggaagatatcctaagaaataccattctggacacaggccattctggacatatcctaggaaatttcaattctggaaaacactttatgatgaagacgccaaaaacaattgcaacaaaaacaaaaattgacaaatgggatctaattaaactaaagggcttctgcacagcaaaggaaatcatcaacaaaccacctatggaatgggagaaaatatttgcaaaccatgcattcgacaaaagtctaatatccagaatccaaaaagaacttagaaaaatcaacaagcaaaaacctaacaaccccattaaatgggcaaaggagaggaccagacacttctcaaaagaagacaaacacgtagtcaacaagtatatggaaaaatattcaacatcactaacattagagaaatgcaaaacaaaactgcagtgagatacaacctcacaggaggcagaatggctattatcaaaaagtcaaaaagtaacagatgctggcgagcttggggagctactcccaggtctttggaaggctgaggcatgagaattgcttgaacctgggaggcagaggttgcagtgagctgagattgggccattgtactctagcctgggcaacagagcaagactccgtctcaaaaaaaaaaaaaaaaaaaaaacccgagagagagagagaaagaaaaacccacagccagcattatactgaatggggaaaagttgaaagcattcccccgagaactggaacaagacaaggatgcccagtttcaccacttctattcaacatagtactggaagtcctagccagagcaatcagacaagagaaagaaataaagggcatccaaatcagtaaagaggaagtcaaactgttgctattcatgattatatgatcatataatgagaaaaccctaaagactcatccaaaaagctcctagatctgataaatgaattcagtaacgtttcaggatacaaaatcaatgtacacaaatcagtagcactggtatacaccgatggtgactgagctgagaattaagtcaagatctcaaccccttttacaacagctgcaaaaacaaacaaacaaacaacaaacaaacaaacaaaaccaaagaaaaaaccccaagcaaacgaacttaggaatatacctaaccaaggaggtgaaagacttctacagtgaaaactacaaaacactgcagaaagaaatcatagatgacacaaacaaatagaaacacatcacacgctcatggataggtagaatcaatattgtgaaaatgaccatactgccaaaaacaatctacatcatcattcttccctgaactagaaaaagcaatcctaaaattaatgtggagcccaaaaatagcccgcataaccaaagcaagactaagcaaaaagaacaaatgtggatgcatcacattacttgacttcaaactatactataaggctatagtcaccaaagcagcataacactggtataaaaataggcacatagaccaatggaacagaatagagaactgagaaataaagccaaatacttaagccaactgatctttaacaaaggaaacaaaaacataaagttgggaaaggacaccctattcaacaaatggtgctgggataattggcaagccatatgtagaagaatgaaactggatcctcatctctcaccttatacaaaaatcaactcaagatggatcaaagacttaaatctaacacctgaaactataaaaattctagaaggtaacattggaaatacccttctagacatttgcttaggcaaagacttcatgaccaagaacccaagagcaaaggcaacaaaaacaaagataaatagatgggacttaattaaactaagaagcttctacacagcaaaagaaataatcagcagagtaaaaagacaacctatagagtgggagaaaatgtttacaaactatgcatccaacaaagtactaatatccagaatctataaggaactctaacaaatcagcaagaaaaaaccaaattatcctatcaaaaagtgtgctaaggacatgaatagacacttcccaaaagaagatatataaatggccaagaaacatgaaaaaatcctcaatatcactaattattagggaaatgcaaacaaaaccacaatgcaataccatctcactcctccaagaatagccataatcaaaaaaataaaaaaaaaaaatagatgttgccatgggtgtagtaaaaaggaacactttcacactgctggggggaatgtaaactagtacaaccactatggaaaagagtatgaagatttcttaaataattaaaagtagatctaccatttgatctagcaatcccaatactgggtatctacccagaggaaaagaagtcattatatgaaaaaaacacttgcacacgcatgtttattgcagcacaatttgcaattgcaaaaaatacggaactagctcaaatgcccatcaatcaatgaatgcatacagaaaatgtggtgtatatatacgtatctatgtgtatatatgtgtatgtatacacacacacacacacacacacacacacacaccatcgacagaatactactcagccataaaaaggaatgaaataatggcattcacagcaacctggaaggagtcggagaccattattctaagtgaagtaattcaggaatgaaaaaaccaaacattgtatgttctgacttataagtgggagttatgctatgaggatgcaaaagcgtaagaatgatacaatgggctttggggacttagggggaagagtaggaggagggtgagcgataaaagactacaccttgggtgcagtgtacactgctctggtgatgggtgcaccaaaatctcagaaattaccactaaaaatattttccatgtaaacaaacaccacctgttccttaaaaactaatgaaaaaagaaaaaagacatgagatcaacctaaatgcccatcaatggtgaactggataaagaaaatgtggcacataggagggggtatatctcagggttagagcatcagactgcggaccaagaaaatgtggcacatatacaccatagaataatacacagccacaagaaagaacgagatcatgtcctttggagcaacgtggatggagttgaggccattatcctaagtgaattaacacaggaacaggaaaccaaatatcccatattcttacttataagtgggagctaaacactgagtacacatggacagaaagaagggaacaatcgtcactaggtgaatttgagggtggagggtggaaggagggggagaatagaaaaactacctattgggtattatacttattacctgggtgacaaaataatctgcataccaaacccctgtgacatgcaatttatccatataacaagcctgctcatgtaccccttgagccgaaataaaaattggagaagaaaaaaactcgtaagagttgtcactttgggtagagttatgggcattatgatttgaaggcatattctaaggtcattcctcctttatttataaagttctaatttttaaaataaaagtgcatttgagtattttatcataaacattaatttaagaattcactggattttgtagtaactatgtaatggatgaactttgctatgagtgtcattggaatggataagcagagacaaaagttgatgaattaagaaatgaaaaggagttaggatctagagacagtagttacagacttattttgaggaattcaaacataagacaaatggatggtagataaagatggatggggcattggatatacggcaagagtttttgtttgcttgctttctttaaaatgggagagtttatatttatacacctatgtctatataaaatgtttctcaaatatacttatatatatacacatacatatatatgaaatgtgcaactgtacttacatacagctatgaggaagaggccattagatagattaaaacatacagatatgttataatacagatgaaaaggaataaattgatcatgtgaattttcttgatgataaacatttaggggctatgaatgtttgttaaaaaaatttcgtacaatttgggacatggctctgcttttaatcaactgctttccaaggattttaacactgaaacgaattttaatagagcttttctatacaacattctgaatattttaacagttttaatgaagcatccttaattgaatattttcataagaaaaaatgagaaagaaattaccctaatagaaatgcccattgccagggaaatttcataatgaagtgtgaaaaaacagcagctgcacttgcctccataaggcatggacctacagccaatctgaaacaaacgaccttcaaatgcctcaaagcctgaaacacaaaacagtcacacttagatacatttacaatggccaacaagaaaattattttaacaaatgtcaaactataaagtcttttttcataagaagctttcactaaacgaaatctcatttcaacagattgtcccactggactttgaactctattacattttatatgtcatcataggttggattataaacaatttcatctttttaaaaatattattatattttaattattaaaagatcaattttactgtgattaaatagctaatgctaccttcctgaactttcctaataaatagtataataatagtgtcctattagtgttttcccattaactttttgatatgaactgtttgattaacttaataagtataaatagaataccaacatgccaaagaaaataacttaaaaactgcataattcattttaaaagggagaacttttcaatgttctccttggttcatactttctgctggagaatataatcttattggctataattatttatgctcttgagctatttctattaaaccacatttgccacatttatttgagtggctgtcatattcatgaatagtcatcttcttatagatgggatttatgatccctagaatgtaatattttaagaaatgctttaaaagattggattttacaataatgcaaagataatcaggaacataatcctgtggagaaaatgtcataaaaaaattactgaaatccttaatctccctaaaaaaagaaaaagacttttataaggtttttcttatcctatgttaactgaaaagtacatacttctccatagaagagcctcccaaataatataggtgctatataagagacatttatctctgtgcaaatgattagatcgctaataaagaccttacaacacagtcaattctcttcatatcagtgataatgatggctagacatagaaattagggtgccaatatttctatacagtctttttttcttctgtttttttcttctgtttgtttgttttgttttgttttttgagacggagtctcgctctgtcccccaggctggagtgcagtggcactatctcagctcactgcaacctccgtctctcaggttcaagcaattctcttgcctcagcctcccgagtagctgggattactaggtaaatgccaccagcccggctaatttttgtagattacaggcatgagccgccatgcccggcctttttttctttatcttaggtttgtttacagactctatttggaacaggaaaataaaatttttgcttctttttctttctcaccgtcctctaatatttgaaataaccttactcgatttgtaattgtaaatctacctgtggatcgagtccaagcccagctcttattagaataatggtaagggcaatgcttcttaaaattgaagaccatgtgttaggaacatggacatgttcattgatgaatggaacattcctaatcgtaaaaccagccagtaacatcccttaaaagaaagaaaataaagatacatgacagttcatttttctgagaaagaaaacggaaatgtttactttcttttctaatgcactatgtctctcattattttggtaaagggcaggttacaagcaagtagagaaggcagcatgaataaaggaatggcgataagaaacaatacacctaaatggggttcaacaagtaagttagtgttgctggaacatacagggcaaggaaaggagggaggagaatgagcttgggtgggccagatcatagaaaggtctccccccactttggcaaagtaaggcaccatgggaaggttttaggcaggaagtaacataatgagtcttgcgttttttatgtgagggtcttggtgaattagtttgggataaaactggagacagagaccaaattgaaggctctgccacagtccacgcaaaagttggaaacaaatagcctaagctagagcaaaagagaaagtttggagaggaggaaaatgattcaataaatacttagaaggtgctgtaagaaaattgtggatacagaagggacagcagagataagatgtagagattatctctactgacagtgtactgaatatatatttatttttgaggacagggtctcattctgttgtccaaggtgagtgcagtgatgcaaacatggctcactgtaggcttaacctcctgagctcaagtgatcctcttgccttagcctcctgagtagctgagacccagaaaaatttttaatattttgtaaagacaaggtctgctatattgcccaggctggttttgaactcctgggctcaggtggtcctcctgccttggcctcccaaagtgctgggattatgggcatgagccaccgtgcctggcccactgtactgaatatttagatatatttgaatacagtaagttctcacttaacatcatcaataggttattggaaatggcaactttgagtaaaatggtatataacaaaaccaattttagcataggctaaatgatataaacaacagtcaatttcctacagcatatttccggtcacaaaacatcaccaaacttctaaataaagatccaaaacacttctagtattaaacaatgaaataaatgtgagctctacatacactttagaaagttttataaaaacaaataagataattatttacttaatttttggtgaatccatgagtgatggtggttatagcggtgatggttaaaatcaaagaataaatgtttacaaagtgaaaattgtaaggagcacctcctcccactatgcagttcaaaaacaatcacaaatatggtaggctggctgagagttttcatatcacattgtctattgtcatgcatttgtatggttaccatatacttaacaaaattttattttacaataatttgtattcattcatttattcatcgtacaatccacttattctagttcagggtcaaaggtgactgaaacttaatccaaaaaaatcaaggagggactccctccctaacacattccatgaatctagtatcacagttatacccgaatcaggcaaagccatacacacacacacacacacacacacacacacacacacacacactactggtcaatatccctgatgaacatagatgcaaaaattctgaactagcaaaatgaattcaatagtacatcaaaaagataatatagttaagtggattttactccagaaatacaaggatggttcaacatgtgaatcattcttccataaatacatatacacacatatgttcattgtagcactattcacaataaaaggacatggaatcaacttaaatgactaaataaagaaaatgtggtacatatacaccatggaatgctatgcattcataaaaaagaatgacatcatgtcctttgcagcaacatggataaagctgaacaccattatcctaagtgaaacaactcagaaacagaaaaatcaaataccacatgttctcacttatatgtgggcactaaacaatgggtacatatggacctaaagatggaaataatagacactggggagtccaaaaggagagagggttggagggttaaggttgaaaaattacctattgggtatagtattcactatttggtgatgggttcactagagcccaaatgtcaccattatgcaatatatccatgtaccaaacctgcatatgtaccccgtgaatctaaaatttttaaagattctattaaacaataaagcaacaggaataatgtactaaggatattaaatttattttaaaaataaattttggataaaacttgtgtgtatatatgtagacagagaaataaatgcatctataaaggagctgtacacacacacacacatacagtaaatacatacatgaagaaactatataaaacatactacattgaaatatttctgaattataactaattcaacaagaaaatgttcaacatttgcatatagtcaataataaagaaaagagagctaattatatacttaccaagaagaggtggaagtggaggcactaaaggtattctaatgagttgtaaaatttttcccccaataatggcactataaaaaataatgaacaacccaaataaatttccaccagggagagcttcagagcctaagattgaccaggtcatacaccatatcacaaacagtataactcctgaaatacaaaaaagtgtacagctatatatctacatacacatagatgtatacaaacaaaggatcaattctcttttatcatatatactaatagccagttttataaaatgatacatggtatagatcaacattgcttactagtttggtgaaagagatatctgcttaacatatattccaaataacctgtcaatttatgaagtaggtttcaaacaaagtgtttttactttaaaaatatttaaaacctatatgtgggccaggtgcagtggctcacaccttaatcccagcactttgggaggctgaggcaggctggatcacatgaggttcaggagtttgaggccagcctggccaacacagtgaaatcccgtctctactaaaaatacaaaaattagccaggcgtggtggtgcgtgcctgtaatcccagctacatgggaggctgggtcaggagaattgcttgaacccgggaggtggaggttgcagtgagccaagattgtgccactgcattccagcctgtgtgacagagtgagactcagtctcaataaaaaaataaaaaaataaaaaaaacctatatgtgaactctggaaaatgctaaccattataatatatgatagttaaaaacatcatggcaatatgatgagatttacttcattttatattttaaaatagctttttcatcaggatggaaaataagaggatgactggctgtgataagaattcacaaccttattgaagatcacagtgtcaaggtgccaaatcttttaagaggaacctactaaatctttgtattgaaaggataattcaactgatatttggcataaatgtattagaggaggtaatggctggaagaaatgaacctagattttgtgggaataaatataaagtatcttagattatgtgtaggaagtagaggtagataagatgagtaggtataagttactagacatcttgtttctggcaactaggtgctactcactgaggaatccataggtttctataaaggacagacaataacatggtaaatttccatatgctaattaaattgctacctttatttgctatgaatcataattgctaatgcttttaatattcttaaaacagtttatatgcattttttagctatgacccctttccggctgtatagaatttgccagggtaaaagaggacgattttgactcactccaggcagaaagttagaacaaagtatctctttcctcctcccctctgattattgtcatcctgcaaaactggaagccttggagggctaaactcttactaaaagaatggaccaggctgggcatggtggctcatgcctgtaatcccagcactttgggaggctgaggcaggtggatcacctgagctcaggagttcaaaatgagcctgaccaacatggtgaaacgctgtctctattaaaaatacaaacaattagcctggcctgttggcgcatgcctataatcccagctacttgggaggctgaggtaggagaattgcttaaacccaggaggcagacattgcagtgagctgggatggcgccacttcactccagcctaggtaacaagagcaaaactccatctcaagaaaacaaaacaaaacaaaacagaaaacaaaacaaaacaaaacacggacaagaaaatgtcatcctactgacaaattgagaagacaaggcagtttgtcttagctggtctctgggtggcaaagtcttttttgagaattcataggtaaaactggcctcatccaacttatgtgtagggctcaaattacattatgtgcacaggttagggatcccaaagttctaaacctaccataaaagtgtccctgcatagaagtatccctagaacacacttagtagatgctaattcaaaaaatctctaatagacagtcctgatcccagactgcataaagtctcaaaggtaaagccaagtgaatctgaacttaaaataagaagaaatatcccatgagcaaaagttaacagatactacaaagaatgggattagatgtctgaaaaccttagctaatagaaccactagatagacactataaaatatgtattttcaaagggactagagacaatttttaaaaattggagacatgagaagaagaaattacttgaaagcattgtaaaataattaaatagaacatctagaaaaaactgtaaaatttactcaactaaaaaaaaaaccactaagtacccaaacagcagtctagacatggctgaagagagaacacagcaaagtagtagatatgaggaaattacttaagagcatagcacacacacacaaaaaaatgaggtggaaaatgagagatttagattatggaaaagatctaaaacacaactaatagtagtttcagaaacataattgaaagaatgaagaagatataatatttgagaagaaaactggcttcaaactttacagaattgattagggtttttattgatttggacacaggaagtcaaatgagttctaatcaggattaagtaaaaatagatacttagataaaatgttgagaaactatagactaccaaaggcaaaaataaaatcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatcgccattctaactggtgtgagatgatatctcatagtggttttgatttgcatttctctgatggccagtgatgatgagcatttcttcatgtgtttttttggctgcataaatgtcttcttttgagaagtgtctgttcatgtccttcgcccactttttgatggggttgtttgtttttttcttgtaaatttgtttgagttcattgtagattctggatattagtcctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgatttcgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgctggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctcaggcaaaaataaaatcttaaagaatctagacagagaaaaagagattaatcataatcgaataaacaatagagcagattctcagtacttatcagcaacaatagaagatggaagataaataaagtcttcaaagtacagagataaagaaatcattcaatgttgaattctgtagccagttaactgtcactcaaacaaaagacaaatgaaagatattgtcaaacaaatacatttaagaacatatgccattttttaccagggaaaaatctactgaaagatatgctttagaaatatgacatagaaccaaaaaggaaggaacaatgtgcaaagaaattggtaaaatgtaggttagtctaaacaagtactggttgtgtaacacattactaatgaaaattgttaatcagaggatataaagataaggttgggaggtgacatgaaaaggttggcaatttatttccacaccaaaactccccccaaaaattgcaaaaataccaaaaacaaacatttcaggaccctgaaaactcatcaaaggcagttatcaaattaagaagcatttatccttgaaaaaagtgttagggttttgggtaggattggtaaaagtctgagcccttcctgactggggttgctccctgatatggtttggctttgtgtccccatccaaatctcatcttgaattgtactcccacaattcccacgtgttgtgggagataattgaatcatgggggtggttccccccatactgttctcgtggtagtgaataagtctcacaagatctgatggctttatcaggggtttctgcttttgcatcttcctcattttctcttgccgccaccatgtaagaagtgcctttcacctcccgacatgattctgaggcctccccagccatctggaactataagtccaattaaacctctttttcttcccagtcttgggtatgtctttatcagcagaatgaaaacggactaatacactctcatctctcttctcatccccaagctcagctgggaaaaacagtagttttaccagtttgaagctggatgtaaaacccagcagctttcctgttagggctgggggcaggggtggatttggtatggagtagagggaagaaatcaatggttttgccagttaaatatagcagagtggtttgagaatgaacagacagaattgcagctttgctagtctgaggttgcagtttcaattggggaagtggaagacaagacaaaaatttaaatgagagatcctgagggtcaataggtgcagcaaaccaccatggcacatgtatacctgtgtaacaaagctgcacgttctgcacatgtatcctggaactcaaagtaaaattaaaaaagaaagaaagagagagagagaaacaacaaacaaagtggaagaaagaaagagagagagaaagaaagaaagaaagaaagaaagaaagaaagaaagaaagaaagaaagaaagaaagagagagaaagacccacatgcaaggctagagttttccagttccaagttccaattctctcactgagaagagtggctcacggtgcctaaactgtttatacaaacaatatggtttactctgaacagctgcttttcttctgggagtctggaattctggtacatgtgaaggacagtaacctccgtaaaatcctgagtactgagtctctaatgagactctggtcctggtagacgacattgcacatgtgctgtcaaaatttcatgctggggaagagaaacacatccttgtaactccacaggagatgattccaggaagtttgtgcctggtatcctccagactttaccacacacaactttttccctttgctaattttgctttgtatccattcactataataaattaaaaacctgagtattactaaaaaaaaaaaaaaaagactgatcctggaaaggagagaataatagaaagtttgtgataagttctccacacatatatggccgattggaaaagtatggaagtgcaggaaagactcaagagagtatgacaaaaagtaaaaatgaagtaagacttgagtattaattgcaactttgaatgcattcacccacccacccacagattatttggcagacagtggaagccttactagctttaacataatgtctctccaaaatcaagctatgcaacagacacaaaggaaatccctagaaagacaggctaaaacaacaataacaacaacaacacaatataaaagacatcactgctgaaaaccactgggcagaaggattacacagcacatgtataggccaattaccaaaacaataacaacaacaaaaacaatcacaaataaaaaccaaatccagatttgctataatgtgtaattaaagtgtttagttttcaattaaaaattatcagacatgtaaggaaacaggaaaatatggttcatactctggaaaaaaagcagtgaatagaaactctcaattcagatactggatttagaaagaaagttttcaaagtatatattataaatatgttcaaattaaaaatatgataatgtgctgtctaatagagaacatgaataaggagacagaatatatttaaaaatagaatctagaatcgaaaagtacaacagttaaagtgaaaaaatcactagcgaggttcagtagcatatttgaccttgtgaaagaaagtatcagtgaacttgaagatagaccaatagaggttaatcaatctgaagaacaaaaagaaaaaagaacgaagaataataaacagatcctcagaaacttatgggataccatcaagagcactaacatatgcataatgggaattccaggagaagagagagataagagggcagaaaaatatttgaaaacataatgtctgaaaacttcaaaaatgttatgaaaaacattaatcttcaaatataagaagttcaacaaatctcaagtaggataaacacaaagagattcacacctagagccatcatagtcaaattggtgaaaaccaaggataataagaaaatcatgaaaatagcaagagatgacttatcacatacaggggaacaataatatgatcaatactggcatttttatctgaaaaaaatggaggccttatgaagcgacatttcaaaagtggagggaaaaataactgtcaattaagaattcggtatccagttaaatgatccttcaaaaatggagctgaaataaagacatttccagataaataaaaataaagagaacttatccttgctaaagaaacactaaataaaatgcttttaagataaaaggatatgacaccagatggcaacttgaacctataaggaataaacggcactggaagtggtaaataaatttgtaagtataaaagattgtatgtgtgtatgtgtgtatatgtgtgtgtgtgtgtgtgtgtgtattctgatttcatctcttttttaaaaaaagcatctgattattataggcaataactataacaatactgctgagttcatagcatataagaggtacattggatcaaagttgctatataacactggaattaagtaaaaattattaaaccaaagtagattgtaaaaagtgaagatgattgattattataacccccaaaggtacttgggaggctgagatagaagtattgcttgaggctaggagtttgagactagcctaagtaacacaatgaaactctgttgatatagtttggatatgtgtccctgcccaaatctcatgttgaattgtaatccccaatgttggagataggtcctgctgggaggtgaatggatcatgggggcagatttctcctgaatggttagtaccatcctcttggtgctgtccttgggacagtgagtaaattcttgtgagatctcgtcatttaaaagtgtgtggcactgccccttgctcttttactcctgctttcgctatgtgacatgtctttgccttctgccatgattgtaagcttcctgaagccttcccagaagcagatgcctgcatgcttcctgtacagcctgaagaactgtgaggcaattaaaccacttataaattatcgagtctcaggtatttgaaagcaatgcaagaatggactaatacacctgtctctaaaaaatttaagcaaaattacccaggtgtgatgacacatgcctgtagtcccagctacttgacaggcaaaggtgagaggactgattgagcccaggagtttgaggctgcaataagctatgaccatgccattgtctcttaaaaaagtaagccccagagaggccaggcgcagtggctcatacctgtaatcccagcactttgggaggccgtggtgggcggatcacaaggtcaggagatggagaccatcctggctaacatggtgaaaccccgtgtctactaaaaatacaaaaaaattagccgggcatggtggcaggcacctgtagtcccagctacttgggaggctgaggcaggagaatggcgtgaactcgggaggtggagcttgcagtgagccgagatcccaccactgcactccagcctgggtgacagaacgagactccgtctcaagaaaaaaaaaaatcaacagagaaattgaaatagggcactaaaaatacttggttaacatgaaagaagcagtaatgtaagaaaagaaaaacaaaaagacatgacacatagaaaacaaataacaaaatgttaaatgcaagtccaaccatatcaataattatgtgaatggactaaaataaaaaggcaactattactgtacaggactttaaaaaaacaagattcagctatatggtgcctacaagaaacaaactttagataaaacaagcaggttgaatgtaaaaggataggagattaggagacatacatatatatatacacacacacacacacacacacatacgcaaatggtaattatggggaaagaagaaaacataagtgtaattactatatatatgtaatttttttaacctgtaagtcagttttattatctgtaaaatggggataaaaaaattatctcctgccaacataaataggttttgttacaataaaatgaactagtgagcatgaaagaacattgcaatctgttaagatgttcttccaggaattcttgcattctaggaaaatcagaacatttctggttatagaatttttgacattttgaggaaagatattttttaggatatatgtgaaaagaacactttatcttctctaattacatcatggattctctttttgcattgagattttgcttgaatatcaatagacaagacaagggagtggttcaggcacttgtctagtgagcggatcgctgacaggaagcaaggagccagaaggacactcccctgtgctgttggtcaggggcccgcttggctggtgccaaggatttgttctcagtgacaagacaaatacagaaatggagagtggttacaaacttctatagcaatttgacactgtattttataaaaagtaaatatcagtctacatcaaataggaaattaaaaacaaaaacaattgggtattaatctactaagcttagtccctaggtgacaaaataatctgtgcaacaaatccacatgacacaagtttacctatgttacaaacctgaacatgcacccctgaacccaaaataaaagtttttttttttaaaagaaaaacaaaacaaaaaaaccacatctgtttcttcatcacagataatttgagaagcactagtgtcaggaaaaaagaataataaataatatgtacattaaaactcaccagaaaacatatatgcactgggatatctttttggacattaaagaaatgtgaaaaatcacacatatattcctaatgaacttgactatattatatatatatgtttatttagaagtattaaattgaattaagtattaaatttattttttaataagtggtataaaggaaggatgttctgattaagaaggataggtaaagggcaattacaactctgggtagagaaatagtaaaatggccagaaacagactggcaaaggctatggagtaattaatctcacaaaaggaagcagaatttattaatataaataacatagtattgctgatacttaaataattgtgagttatattgaagaattattttatattttaaaatagcaaaaccccccaaaaaacagtgtggtaaagctgtggtgaggtttgtacattttaggaagccttgttatttttagctcatatggttttttgataagtaaaaatttaaaaaaagttaaaaatgatttctctgctgcttaaattccgatacacatctattgagtggtaagatatgagtttagagtcactgtatttttttagtagttctactaataagaaattttcattaagctttactttctttctttctttctttttttttttttgagatggagttttgctcttgttgcccaggctggagtgcaatggcatgatctcggctcaccacaacctccgcctcccgggttcaagcgattctcctgcctcagcctcccgagtagctgggattacaggcatgcagcaccatacccggctaatttggtatttttagtagagacagggtttctccatgttggtcaggctgctcttgaactcccgacctcaggtgatccgcccgcctcagcctcccaaagtgctgggattacaggcatgagccaccgtgactggcctaagctttactttctaaaaattatatcaaaattggtatttctctattatgtaatcataaattatatcaaatatgctgttttgaattttatttttccctttaaacataaagacacacattcagttcattgtgctatataaattaccagtgtgatcacaaattaagaaatgcaattcaaagaattttgcgtacaaggagtcctgaaagtgttaataacttttgatgcaaagataattttatgaaagtaatagaagactaaaaaaaggtacaaaacaattattatgtaagtatcttcctttttctgaatcacccatgattactttttccaccaagcaaaaactgactacatacttcagatctgtctcaaatctccccagcctcttttcctaaacctccccagcctctcaggacagacaggctgctcctgtactttgtgcattctgctatttttagcaagaggcctattttgtcagtgttgtctgaatagtatttgccaactcccagactttcagtcacttatttgtttatttatttatttatttggctcttttcttgtatttcccttttccttttctttcctttctttttccatttcctcctcccttcctttgcttacttatttttttccctttaattcccattcactatttccatgactgtcaaatagtaggttgatcctttaaaatattccttttttaaaatttattgtactttaagttctgggatacatgtgcagaacgtgcaggtttgttacataggtatacatgtgccatgtggtttgctgcacccatctacaatatatcttaaaatgaataaaagtggaaacacgcagaagacatggtgtatggggtgagtgggttgccaagtggatggtggcagggtgctccagggtggccagtggggctaaatgctgtgtattccaagcatggcggggttcctgccttcctgtgtggcagactgtggcatcaggtaagagccacttggtgcccaccctggctcctccattgccttgctctcagcccctggcatccagcccacacctggaggttgagctgcacccactgctctgggtctcagccctgtgatcacctcagtagatattctgagcttggctatgcaggcaacactgagccatagtttactattctttcttgcatttctatcagagagtcagcaaaggtagttgacaaagcccaaaggagaatgttgaggggagttgatgaccttgactttttcatacaggatgaagccattgataaatctatgtatgctacaaagtggtcaatatgactggaatcactgaagactgggatattatggaaaggttcatggagcaagtggtttttaaatatctttgagcagaatctgaggaccattattttttaatgacagaacttccactgaatacactagaaaatacagagcatttttgcagaaattatgtttgaattatttaatgtaccaggattctacattgcagttcaggaggtactggccttggcagtatcttggacatctcaacaagtgggtgaatgtatgttaatgagtatagtcattgacaaaggagatggagtcacccatgttctcccagttgtagaaggttatgtaattgggagctgcatcaatcacatcctgattgtaggtgatactgtgtatttcactcaacagctgctaagggagagggaggtaggaatccctcttgagcagtcactggagaccacaaaagccattaaggagaaatactgttacatttgccctgatacagtcaaggaatttgctaagcatgatgtggattcctggaagtggatcaaacaatacacaggtatcaatgtgatcaaccaggagaagttcataatagatgttggttacaaaaggttcctgcaacctgaaatatttttttacccagagtttgccaacccagactttatggaatccatcttgaatgttgttgatgaatacaaaactgtcccattgatgtgcatggtccactgtataagaatgttgttctttcaaggggtttgaccatattcggggatttgaacctcaactacagagagatttgaagagtggtacatgccagattaaaactcagtaaggagctcagtggcaggagaatcaaacctaagtttgcagaggttcaggtggtaatccatcacatgcaccacaatgccttatggtttggaagcttaatgatagcctcaactctggagttatttcaggcctgtcacaccaagaaggactatgaagaatatggccccagcatctgccaccacagccttctctttggagtaatgtcttagtgtctgccttgaaagcatcatttaatagtgtcatgttggggaacaagtgtccttcagaacccagagaagactaccatttctaaatgacatttggtgttgatgtctgagcagcatgcttgcatcacctagtgcatgaggcacagggcagagtcatttcagtaaaagccatttctttatgtgttgactgttgtatgcccactccttcttctctcactccctttcttcatgcttccccagtttccctcctccttttcacttgagcttttttgttgacaaataccattctgaaggaatttaaatgtgactttgaaaattgttaagaggaaaaaaaatttcaaaaatggcccaaaatagttctcccccaggaaataatgcagtggtataaatccttttcccccagcctatttttataaataaaatgttataaacttaaaatacaaaaaaccaataacataacattatttacaggatgcaattaaagcagtgtatagaggaaaatgtatagctttaaaaacagaaagaaaaaataatctaaaattggtaattaaaacttccatcttaagactctagaaaaagatgagtaaaccaagccaaaagtaagtaggatgtatgaaataaaaaggtcacagtggaaaacgataaatacagaacaggataacattaaaaacaaccaaagaaactcaaaattgcttatttcggaaagtcaagaagataaataatatttagttacattgaccaagaaaaaagaaagaagacactaattcccaaaatcaagaatcaaagaaaaatatcatcacagaccctacccttaaaaggatgttaagaaaatagcataataactttaaggcaaaaaattcgacaacttagataaaatagaacaattcctagaaagacacaaattaccaaaactgactcaaggaaaaaggaaaaaaaaaacaaatatcaatatcaagtaaagaaattgcatcagtaatttcaaatcttcctatagagaaaaaatatacttcactggtgaactctatccaactattaagggaggaaataataccaatgttacaaaaactttattaagcaaatagatgaggaaggaaacttcccaatgaactttatttcatttgatatcaatattaccctgatatcaaaacaagacaaagacattacaagaaaacacagctatataccaatatcccttatgaacctagacataaatattcttaaccaaatattagtaaatgtaattgagcaacatatgaaaaggattttataccataatcaaatgaagtttatctcaggaatgtgaggtggttgacttaacatccaaaaatcaatgtaataaactatattaacagaataaaggacaaaaccatatgatcacctcaatagatgcagaaaagcatttgacagaattcaacactcatatatttaaaaaaatctcatcagcttatgaatagaagggaacttcttcaaatgatcaaggcatctaccagaagcctacagccaacatacttaatggtaaaaatgtgcttacctctagattaggaaacatgcaaagatatctgtgtttaccacttctattttttccttgcaatagtcaaggaaaaaagttatggaaaaaagacaactctttttattgttagccttgtatacagaaaatcctaaggaacacacccacacacacacacccacataccacaccccctcccagacttactagaactaagagggtggcttagcaagtttgtagagtatatgatcaatatacaaaaatcggttatatatatagtagcaacaaacagtacaaagatgaaataaagaaaacaattccaatcacaatagcatcaaaaataaatgtcttagtttgttttatgttgttataatagaatacctgagactgtataaagaggtttatttagctcatgtttctccagaccgggaagttcaagaagcatggcaccagtatctgcttagcttctggtgagggctttagtagtgcatcacaacatggcagaagaccaaagaggaagtgggaatgtgccaagaggccaaacacaaggtacaaccttgtacaatgggttgctttataacaatccattctcagggtaactaatctattcccacaggaaccaatccagtttcatgagagcaagaactcactcactatatgaggactgcaccaagctgctcaaaatggcagagcccccatgacccaagcatctcccattaggccctgcctcttaaaggttccaacatgatttttggcagagacacggaaaccatggcattccacccttggaaccccaaactcatgtccctcttacactataaaatgtaattattcaatctcaatggtccccaaagtcttaatgtattccagtaacaattcaaaggtcaaagtccaaagtctcatataagactcaaggcaagttcctcctagctatgagcctgtaaaataataaaaaaaaaaacaacaagttatttacttccaagatacaatggtggaatagtcatatggcagacagtcccattccaaaagggagaaataggccaaaagaagaaagaggtgacaggcctcgagcaagttcaaaagtcagcagggcagacactaaatcttaaaactccagaataattctccactccacgtgctacctcctgggcacagtggggagtttttatccctaaagccttgggcagccccacctccattgctttgttgggcatagccacatggctgctctcactggttggaattggatacctatggcttttccaggctgaggttgtatggtggcaatggctctatagttctggagtcccagtggtggtccacttcatggattcactaggtattgccctggtacagactctttgtggcagctccaaccctacatttctgctcagcattgccctagggaagatacactgcagtggctctggccctgcaacaaatctccacctgagctcccagtcttttcagtacattccttaaaatctaggtggaagccaccatgactacacttctcttgtattctgcacatctgcaaaactagtaccacatggttgtaaacgccatcaaggcttaccacttgcaccctccagagtgctgtcatgagctgtacctgaggctgcttgatccacgactgcgtgccaccaaggtttatggtttgtatcttgtggaatggcagcctgagccatacctgggtatgattgtgccatggctggggtggctgctgagggctgtgccagaatttggggagcaggatctcaaaacagcacagggcagtgatgcatggattctgtctcttaaaaccattccgtcctcctagacctctggaaaggcaacctcaaaaatttctgaaatgtcttcagggcctttaaaaaattgtctcaataattatcaactggctctcttctctcagtgctaatctctttagtattggttgttctgctgcacccttggattcctctcctgaaaatgctctttcattctctaccacatggccaggctattaattttcaaatttttatgcttgcttcccttgtcattttgcatttcactgaatgtagtaagaagtaactacatagctgctctatattttgcttagaaatttcttctgccaggtaccctagttcatcactcttaagtttggccttccacaaaaccttagggcacaaagccttagaaacaacacagccaaatttttgctatggtctaacaaggatgacttggtctccagttcctaataccttgttcctcatttctatctgagatctcattagaatggcctttgctgtccatatttttatcagcattgtggtaatgactacttaaccaatctctaagaaattctaaactttctctcgtctttttgttgtcttctgagccctcattgaaattatccttaatgctctgtttatggcaatacagtctttttctagtctgctccttcaaacttgtccaacttctgcccattacccagttccaatgatgcttctgcatttttgagtatctaaatagcaacatcccactctcagtacaaattttctgtcttagtccgttttgtgttgctataacagaataccggagactgagtaatttataaagaggtatatttggcttgcagttctgcaggctggaaagaatgacactggcatctgcttgggttctggtgaaagctttagtgttgtatcacaatatggtagaacaaggtcaaaggggagtaggcatgtaccaggaggccaagcatgaagcgtgacctcaccgtatagcaactcattctcatggtaactaatccattcctgagacaactaatcccacaagagtgagaactcactcaccagtgtaagaatagtaccaagctgcccacaaaagaaaagctcccaagacccaaacacttcccattaggccccacctcttaagcattccaacatgagttttggtaaagacactcaaactatagcaataataattaggaataaatttaacaaaataagtgcaaaacctttgcactgaaaactaaaaaacatcactcagataaatgcctaaataaatggagagatatatcatgttaatggattagatgactcaatattgttagatgtcaattgatctacaaattaactgcaattcctgccaagagtctagaaagattattggaaaaattgacaagctgattctaaaattatatagaaatacaaaaatacctagaatagccaaaaaaatcttgctaagtaagaatgaagttagagtacttaatactgtcttatttgaaaattcagtgtaaagcagcagtagtcaagacagtgtagaatccacattaagagagatagatagatcaatggaactaagtggagttcagaatccaacccacataaatagtcaattgattttcatcaaagatgctaagacaattcaataggaaaaagatgttctttcaacaaatgattctataataactggttattcatttacaaaaactaaacctagatccttaggtcatatgcaaaaattaactaaaatggatcacagacctaattgtatgagctaaaactataaaacttctaggaaaaaaatataggagaaaatatttatgaccttggactaagcaaaggtttcttagatataatatcaaaaacatattccataaaagaaaaactggtaaattggacttcatcaaaatgatgaaatctttgcttttcaaatatttcttaaataaatgaaaggagaggattgttccaagatggccgaataggaacagctcctgtctgcagctctcagcacaactgacgtagaagacaggtgatttctgcatttccaactgaggtacctggttcatctcactgggactggttggacagtgggtgcagcccacagagggtgagctgaagcagggcagggcatcgcctcatccgggaagcagcacaaggggtcgggggatttccctttcttagccaagggaagccgtgacagacggtacctggaaaatctggacactcccaccctaatactatgcttttccaatggtcttagcaaacggcacaccaggagattatatcccctgcctggctcggtgggtcccacgcccacagagccttgcttactgctagcgcagcagtccgagatggaattgcaaggtggtagcctgggctgggggaggggcgtccaccattgctgaggcttgagtaggtaagcaaagcagctgggaagctcgaactgggtggagctcactgcagctcaacgaggcctggcagcctctgtagacgccacctctgggggcagggtatagctgaataaaagccagcagaaacttctgcagacttaaacgtccctgtctgacagctctgaagagagcagtggttctccaccatggagtctgaactctgagaatgggcagagctcctggtagggactgactgacacctcatatagccgggtgtccctctgatatgaagcttccagaggaaggatcaggcagcaatatttgctgttctgcagcctccaatggtgacacccaggcaaacagggtctggagtggacctccagcaaactccaacagacctgcagctgagggtactgattgttagaaggaaaactaacaaacagaaaggaacagcatcaacaaaaaggacatccacaccaaaaccccatctgtaggtcaccatcatcaaagaccaaaggtagataaaaccacaaagatggggggaaacaagagcagacaagctgaaaattcaaaaaaccagagtgcctcttctcctccaaaggatcggagctcctcgccagcaatggaacaaagctggatggagaatgactttgacgagttgacagaagtaggctttagaaggtcagtaataacaaacttctccgagccaaaggaggatgttcgaacccattgcaaggaagctaaaaaccttgaacaacgattagatgaatggctaactagaataaacaacatagagaagacctttaatgacctgatggagctgaaaaccatggcatgagaactacatgacgcatacacaagcttccatagctgattcgatcaagtggaagaaagggtatcagtgatggaaaatcaaatgaatgaaatgaagtgagaagggaagtttagagaaaaagagtaaaaaaaaacgaacaaagcctccaagaaatacgggactatgtgaaaagaccaaatctaagtttgattggtgtacttgaaagtgatggggagaatggaaccaagttggaaaacactcttcaggatattattcaggagaacttccccaacctagcaaggcaggccaacattcaaattcaggaaatacagaaaacatcacaaagatactcctcgagaagagcaaccccaagacacataattgtcagattcaccaaggttgaaatgaagggaaaaatgttaagggcagccagagagaaaggtcgggttagccacaaagggaagcacatcagactaacagaagatctcttggcagaaaccctacaagccagaagagagtgggtgccaatattcaatattcttaaagaaaagaattttcaactcagaatttcatatccagtcaaactaagcttcataagtgaaggagaaataaaatcctttacagacaagcaaatgctgagagattttgttaccaccaggcctgccttacaagagctcctgaaggaagcactaaacatggaaagtaataaccagtaccagccacacaaaaacatgccaaattataaagaccatcgatcctaggaagaaactgcatgaactaacgagcaaaataaccagctaacatcataatgacaggatcaaattcacacataacaatattaaccttaaatgtaaatgggctaaatgccccaattaaaagacacagactggcaaactggataaagagtcaagacccatcagtgtgctgtattcaggagacccatctcacatgcagagacacacataggctcaaaataaagggatagaggaatatctaccaagaaaatgaaaagcaaaaaatagcaggggttgcaatcctagtctctgataaagcagactttaaaccaacaaagatcaaaagagacaaagaaggccattatatagtggtaaagggatcaatgcaacaagaagatctaactatcctaactatatatgcacccaatacaggagcacccagattcataaagcaagtccttagagacctacaaagagacctagacatccacacaataataatgagagactttaacaccccactgtcaatattagacagatcaatgagacagaaggttaacaaggatttccaggacttgaactcagctctgcaacaagcagacctaatagacatctacagaaccctccaccctaaatcaacagaatgtacattcttctcagcaccacatctcacttattccaaaattgaccacctagtttgaagtaaagcactcctcagcaaatgtaaaagaacagaaatcacaacaaactgtctcccagaccacagtgcaatcaaattagaactcaggaataagaaactcactcaaaaccacagaaatacatggaaattgaacaacctgctcctgaatgactattgggtaaataatgaaatgaaggcagaaataaagatgttctttgaaaccaacgagaacaaagacacaacatatcagaatctctgggacatatttaaagcagtgtgtagagggaaatttatagcactaaataaccacaagagaaaacaggaaagatctaaaatcgacaccctaacatcacaatgaaaagaactagagaagcaagagcacacaaattcaaaatctagcagaaggcaagaaataactaagatcagagcagaactgaaggagatagagacataaaaaacccttcaaaaaatcaatgcatccaggagctgtttttttgaaaagatcaacaaaattgatagaccactagcaaaactaataaagaagaaaagagagaagaatcaaatagatgcaataaaaaatgataaaggggatatcaccactgatcccatggaaatacaaactaccatcagagaatactataaacccctctacacaaataaactagaaaatctagaagaaatggataaattgctggagaaatacaccctcctgagactaaaccaggaagaagttgaatccctgaatagacccattaacaggctctgaaattgaggcaataattaattagcctaccaacaaaaaaaagtccaggaccagatggattcacagctgaattctaccagaggtacaaagaggagctggtaccattccttctgaaactattccaatcaatataaaaacagggaatcctccctaccacattttatgaggccagcatcatcctgataccaaagcctggcagagacacaacaaaaaaaagaattttagaccaatatccctgatgaacatcaatgcaaaaatcctcaataaaatacaggcaaaccgaatccagcagcacatcaaagagcttaaccaccactatcaagtcggcttcatccctgggatgcaagcctgggtcaatatacacaaatcaataaacgtaatccatcacacttcagccttcgagtagctgacaggtgtgccaccatgcccagctaatttttgtatttttagtagagatggggtttcaccatgttgcctaggttagtcttgaactcctgggctcaggtgatctgctcgcctcggcctcccaaagtgctaggattacaggtgtgagccactgtgcctggccaatctatgtaacttttcatggaaggcaaaactataaaaaaagcagatcatttgttacttgggacttgggtaggtgggagggaggatttaatgcaaataagcatgaggaaactttttgagattatgtaagtattcaaaaactgaatttttgtaattgttgtacaactctataaatttaccaaaactcatcaaaatgtgcatttaaaataaataaattttgtggtctgtatattatacctcaaaaaagctgataaaatataaattggaacaaaagtactggaaaaccataagttggagacaaatgagggtgatcaaaattaatgcatccttcaagatgaaacgtgattttaattttaaaattaattttttaattacttgttaattcaagtacacatattaaatttcaagggtaatcgtgaatagaatagaactagaacatacaacttttaaacaaatagaggggaaaaaccttgatcaatctaacagaatgcattggggaaaagtattagagaaataatatggttaacagaaagcacaaaacatgatgacagaaataaatataaatttatcaataaccacaataaacttaaatggtctaaattagttaaagacagacacttgaagactggattaaaaacatgaaaatccaggtatcacctgtaatagttaaaaacatgaagacacaaaattctgaaggtatgagaagagtaaatgataaataaaacaaatattaaccaatatatggctggtatagctattttcatatcaaaaactataagacaaaaaacattctgaggaataaaagtcattatgtaaagacatctatgcaagtaacaattcaaccttaaaatatatgaagcacaaattgacagaattacaaagaaaaatggctaaatcctcaaccttgaagaaacttaaacctctgagtcaatgaaaatcaaaatgtagtaagattatctcagattttaaccaccgtattaaaaaagcttaatttaaaggaaatatatagacttccatatgctcaaattagagaatatatatactttgaagcctgataaagtcttaggagaactgaacctatactagcctatgaatcaaatcacaacaaataaacaaacattataacatgtggcttatactctgtaactaaaatgcaatttataatagaaaaaaatgtaaatttctttcattttcaaactaaaggcataccttaaataatttttcagtcaaagaagacatgaaaacaaaaatcagaagatatttggaagtgaaatactacataacaaaacttgtgagatagagctgaggcagtactgaaagggtaatttatatctttaaatgtttatattgaaaaatagggtgaaaattagttaagcgtccaccttcggaagtttggaaagagaaaaagagattgggcatggtggctcaggcctgtaatcccagcactttgggaggtcaaggcgggcggattacctgaggtcgggagttcaagaccagcttggccaacatggtgaaacccccatctctactgaaaatacaaaaattagctgggtgtggtggcaggtgcctataatcccagctactcaggaggctgaggcagaagaattgcttgagctggggaggcagaggttgcagtgagccgagattgggccactgcattccagcctgggcaacagagcaagactctgtctaaaattgaaaaaaaaaaaaaaaaaaaaaaaatcggagtaaacctaaataaaataaattaaaggaaataaggcaaaaagtagaaatagacattaataaactataaaacaaaaaaacaataggcaagattcacaaaaccaaatgctgattctttgaaaagaataataaaatagacacacttctggtaagattgattaattaaaaagagaaggcataaataagcaatattaggaataaaaaatgaaatgtaacataaaatatgagtgaaaaaataaagtgaatactataaatgactatatgacaacagtctaaaaacataagtgaaatgaacaacttcgttggctactataacttataaacacttagtcaagaagaaatgggacacctgaatattcctgtatctatttttaaaaattcaatcagtaaatactttctcagaaaacacccactagtatgagatactttaatatgaaagttctaccaaacattcaaagaacatataaataaccactatcacatcaaaataatttcagagaatggaaaaagagggaacaccttcaattcattttgtgaggctaacataaatgcaatataaatatttaagatcattataatccaagaaaattggaggccaaactaagcttagatacaaacatctaaaataaaataatagtaaatctagtaatgtattctaaaaaaattctggacccgttgggtacctcaggaatagaagcaaacatttaacagtttgcccaagcagcttttattttattttattatttttaaagagacagggtcttgccctgctgcctgggttggaatattggcatgatcatatagctcacagcatccttgaactcctgggctccagggaccctctgccttagcctcctgagtagctgggactacaggcacacaccacaatgcctagctaattttaaaaaagtttttattttgtagagatgaagtctcactatgttgcccaggctagcctcaaactcttggcttcaaatgattcttccaccttggtgccccaaagtgttgggattacaggcatcagccacggcacctggcctgagcaggttttaataagtcaccccatgtttggagaatttctaacattattaatattactttcccagtgtagaagccaggaactcaagtttttaaacttcctttgtcatgaaggcatagacacatgatgaacacactgctactgacattaatttctgcttttatctgaatagttggtacctccaggaaaaggaggggaatgaggttggaaaatagtacacaggaagcttcaactatatctataatgattatatatacatatatatatatatatatatatttttttttttttttttttttttgaggctggagtgcagtggtgcaatatcggctcactgcaacctccgcctcctggggatcaagcgattctcctgcctcagcctcttgagtagctgggactacaggtgcatgccatgatgtctggctaattttgtattttttagtagagatggggtttcaccatgttggccaggctggtttgaactcccaacctcaggtgatctgcccgcctcagcccccaaagtgctgggattacaggtgtgaactaccacgcctggccagataatgtttaaattagaaggtcacatgcataaatatgatatcttggacattgatgagaccacatagaaaaactatataaaaagaaaagaggaaaaggcccaggtctaagtcctgagtgatatttggtatttagaagttaggaaaagaagaatggaatatggaagacaagaaaggaagaagcagtgagggaagaagaaaaccagttggtgcctcagaattagaaaaaaaagacaagtgtttcaataagagagtgatcattggtgtcaaaagctggaaagatcttgaatacgatgcagacagaaacgttcactggatttggttaatacacttagtcagataaaccccagcaatttcaccagttacggtcgttttcatactccagagatgaaggataacatttactagcctacgtaatattctaggtcttgaatgtagatatcagtattgatttactttgaacttctactttaaaatcaagaaattaagtctcttctgaaattcaaagatattatcatttcttaacagtcatcaatagttttcatgacatctcatttgaagcaataactaatttatattgcattagctaatttaataaatggtttctgaaagactatatgcaaggataggtcccagtcataaagagctaatacctgctttgaaggaacttacaattaatttaataaaaaagacagaaatgttgtacaaattaaaatggcataagtgccaaagtaaaactggaaaatctggaaaaaaatcataggttcttgaaagatgaaatttcaataggcaaagataaggacatggtaagttaagggataggatggacacagatatagcaacgtgaagtcaagagcacattgagaggtaagtaaatttgtccggatgaagtgagatattttggcaggtgagagtggaaagaaaattcataattgaaacatgaagtgtcttgaatgctttgctaaactttaggagtaaaataaacataagaaatgttatgggctgggtgcaatggcttattatctgtaatcccagaactttgggaggccaaggctggaagatggcttgagcccagaagttgaagaccagcctgggaaactcagggcaatgctgtctctacaaaaaattttaaaaattatccagatatggtgacatgtgcctgcagtcccagctactcagtaggctgaggcaggaggatcacttgagcccaggaagtcaaggttgcagtgagttgtgatggtgccactgtactgcagcctgggcaacagagtgagactctgcctccaaaaaaagaaaaaaaaagagagaaatattatggaagtggaattgatagggcttataaacaaactgaataacagcatgaagaaaaaaggccaagtcaaagatgcttatgagctctctaggctgtataactgagacaatattataacttaaaaaaaaaaaaaaaaaaacagaaaaaaaggaagaagaacaagaggagcagagttttctagtgagaagatgaagatacttttgactacactggtgtaagtgaccttaagagaattacaaacaggattctggttaaataatttattattatgcttgtagttgagggtagatattttgttttagctccctggcaaacagaaccttataggtattcaataaatgtttgctgagtaaatgacattttgatgtatctaaattaatgttacttcaggagagcacctaaacaccaatgttgagaacgtttttgggaatactttaattatgaacttttagaacactagtacaatttttttctaacaaccagaaaaatttcttgtccctaataattcttttcaatgtgccattctcagagccccagctgggtgcagtatatggctaagcaattaatatgggacagctagagttttaaaaatatatagtctatgagaagttacaaatttttaaaaacatattctttttttattattatactttaagttttagggtacatgtgcacaatatgcaggttagttacatatgtatacatgtgccatgttgttgtgctgcacccattaactcgtcatttaacattaggtgtatctcctaatgctatccctccccactacacccaccccacaaccatccctggtgtgtgatgttccccttcctgtgtccatgtgttctcactgttcaattcccatctaagagtgagaataagaggtgtttggttttttgtccttgcgatagtttgctgagaatgatggtttccagcttcatccatgtccctacaaacgacatgaactcatcattttttatggctgcatagtattccatggtgtatatgtgccacattttcttaatccagtctatcattgttggacatttggcttggttccaagtctttgctattgtgaatagcgccgcaataaacatacgtgtgcatgtgtctttatagcagcatgatttataatccttaaatgggatctaattaaactaaaaagcttctgcacagcaaaagaaactaccatcagagtgaacaggcaacctacagaatgggagaaaatttttgcaatctactcatctgacaaagggctgatatccagaatctacaatgaactcaaacaaatttataagaaaaaaacaaacaatcccatcaaccagtgggcgaaggatatgaacagacttctcaaaagaagacatttatgcagccaaaagacacatgaaaaaatgctcaatatcactggccatcaaagaaatgcaaatcgaaaccacgatgagataccatctcacaccagttagaatggtgatcattaaaaagtcaggaaacaacaggtgctggagaggatgtggagaaataggaacacttttacactgttggtgggagtgtaaactagttcaaccattatggaagtcagtgtggcgattcctcagggatctagaactagaaataccatttgacccggcaatcccattactgggtatataaccaaaggattaaaaacgtgttcttatttttaggataatactacaaaacttttctaaaataaatgctctaaaactttttatttgctctctagtatttattgatatggttagctttctggtttcttaatttaccgtacatggttatactcattattaaaagctttttaaatatgatgctgtgaaaggtgttacagagagcaactgcataaatagttctacttatgacagggtaaaaaccactgagcaaacatacttaattgaatggatgacttcttggggaataaaaaagcattataatgtaaaactgtaggtgaaaacccttctcaagttcattgatgttagagacaaacgttttcaactcttttcatttcctatttgctctttgccaagattggaatagtaagtagttaacctgattggtgagaacctcatagttattgagccatatcctagaatcagtaggtaggtttcttttgcctcaaaagtgagaaatccattcctctgtctgttttgcattgtttggatgagtaaactctcctcttttcatttgttattctcagtagtaaacacatgtgggtcaggacccctctaaaaggcatccatttctcttctccagcctctagtgaactccagtctgctcatgatagtgtttttgaggcaagtccttcctcatagttaactgcgtactcaaagtctgctctgaaggatcagctttccagacaggaggagacacgatctatggagaagccttatgtttactccatttttccaaggagatcttacttgggggaagcactggccctccactaatggaactatgttcatccccacttggctccttagtgtctgttctctactgactataacccagaaggaatgtggatattattgtatttttaataggctttattttttagagcagttttaggctcacagcaaaattgagcagagattacagagagatctcaaaaatccccgctctctacaacctacagaatgggagaaaatttttgcaatctatccatctgataaaggtctaatatccagagtccacaaggaagttaaacaaatttacaagaaaaaaaacaaacaaccccattaaaaagtgggtaaaggacatgagcagacacttctcgaaagaagacatttatgcagccagcaaacgtatgaaaaaaagctcaacctcactgatcattagagaaatgcaaatcaaaaccacaatgatttaccatcttatgccagtcagaatggtgattattaaaaagtcaaaaaacaacaaatgctggtgatgttcagagaaaaagaaacacttttacactgttggtgggaatttacattagttcaaccattgtagaagacagtgtggcaattcctcaaagatccaggagcagaaataccatttgacccagcaatcccattactgggtatatacccaaaggaatataaatcattctattatgaagacacatgcacatggatgttcactgcagcactattcacaataaaaaagatgtggaatcaacataaatgcccatcaatgatagactgcataaagaaaatgtggtacatataccatggatactatgcagccataaaaaggaatgagatcgtgtcctttgcagggacatggatggagctggaagctgttatcttcagcaaactaatgcagaaacagaaaaccaaataacacatgttttcacttatatgtgggagctgaatgatgagaacacatggggggaacaacacacactggggcttgttgagggggttgagggacggagagcattaggaagaatagctaatggatgctgagcttaatacctaggtgatggattgatctgtgcagcaaaccaccatcgcacatgtttacccatgtaacaaacctgcacatcctgcatatgtaccctggaacttaaaataaaagttgatgaaaaaaaaatcccggctcccacacacttcctctatgaccaacattccacaccagagtggtccatttgttagaattgataaacctatattaacacatcatggtcacccaaagttcagagtttacattaggttccctcttgggtttgtatgttctatggcttttaacaaatgtataatgacatatttccatcattataatatcatacaaaatagtttcactgccctaaaaatcctctgggctctgcctgctcatccctccctcctctcaattcctgacaaccactgatctttttactgtgtccatagttttgcccctgttagaatgtcatatagttggactcgcacagaatgtagctatttcagattggcttctttcacttagaaacatgcatttaagtttactccaagttgtctcattgcttgataggtcatttcttttcagtattgaataatattccactttctagatgtaccacagtttatttattcactcacctaatgaaagacattttgattgcttctgaattttgataattatcaataaggttgccataaacatccatgtttatgtgcaggtttttgtgcggacttaagttttcagctcatttgggtaaatatcaaggagtgtaattgctggattgtatggtaagtctttttatttttgcaagaaactgccaaactatcatccaaaggggctgtacagtttgtacaactcccacctgcaatgaatgaaagttcctgttgctccgtacccttgccaagatttagtggtgtcagtgttttggattatggccatcctaataggtgtgtagtggtctctcactgttgtgttaatttacaattacctaatgacctatcatgttgagcatcttttcataagcttacttgccatctgtatatcttatttcgtgaggttcctgttgcagtgttgtgttcattttttaatctggttgtttgttttctttttggtgaagttttagagttctttttatattttgataacagtctttatcaaatatgtcctttgcaaatattttcttccaatctgttgcttgtcttttcattctcttgaaagtgtattccacagagcatagatttttttcccttctctttcacagaagggaacagcatggaagaacatacattttaatgttaaggaaatcaagtttatctattatttctttcatggagtgtgcctttgatattatacctaaaactcattaccataccaaaggtcatctagattttctatgttaccatctacatttatagatctgtgttttacattcaagtctatgatatgtttcgaggtaattttgtggaaagttttaaggtctatgtatagattcctttttttttttgcatccatgtggaggtccatatgttttgtcatgatgtatagttgaaaagattatgtttgctccattgtattgcctttattcctttgtcaaagatcagttgacaatatttttgtgggtctatttctggactctattctgtttgattgatctctttgtctagtcttttaccaataccacattgtcctgattatcgtagctttacagtaagtcttgaagttgggtaatgtcagttctctgattttgtttctctctttcaatgtcgagttggcttttctgggtcttttgcctgcccaaacaaatttttaaataaatttgttcatatccacaaaataactttcaggaattttgattgggattgcattgaatcaagttaggaagtactgacatctgacaatactagtctttcatgaacataaaatatttctcaatttatttagttcttttatttatttcatcagagttttatagttattactcaaatagatcttgtatatatttttgttagacatatatctaagatgttaatttttgtggtgctaatgtaaatggtgctgtttttaatttcaaattccatttgttcactgtggcacataggaaaacaattgacttttgtatattaatcttgtacctgccatcttactcacttagtagttgttccaggagttttttttacatgattcttttagaatttttaccgatacaatcatcttatctgtaaacaaagacaaatttatttcttccttcctaacctgtataccttttatttactttccttgtcataattcattagttggacttccagtacaatgttgaaaagaagtggtaagaggaggcatccttaccttgttactgatctagaagaaaagcttctagtttttcaccaatgagtacaatgttacctgtaggattttagtagatagtttttatgcagttgaggaagtttccactctattctagcttgctgatagttttttatttttaatcatgattgggcattggattttgtcagatacctttctgcatctactgatatgatcatgtgatttttcttccttagcctgttgatgtgatggattacattacttaatttttgaatgatgaactaatctcatatatctgggataaatcccacttggtcatggtcatggtgtatcctttttatatgctgtttaattcaatttgttaatactttgttaagaatttttgcatctatgtgcatgagagatattggtctgtagatattggttctataatgtttttgccagattttgatattaggaatgctgaccttatagaataaattggaaagtattccttctgcttatgtcttctagaaatagctgagaaaattgtataatttcatccttaaatgttttgtagaatttatcagcgaatccacctgggcccagtacattctgttttggaaagaaacactgattcaatttctttaatagttataggcctattcatattatccacttcctcttctgagttttggcagattgtgtctttcaaggaattggtcctttttatctaggttattgaatttgtgggaataaagttgttcatagtattactttattatccttttaatgcccatgggatctgtagcaatgtcttctcttttatttctgatataagtaatgtgtgtcttctctcatatttttcttagttagtttggctaaaggcttatcaattgtgttgatcttttcaaagaaccaggtttttgtttcattgaatttattgatttcctgtttttaattgtactgatatctactctaaattatattactttttttcttctgcttactttgaactcaattagctcttttctttctagcttcctgaggtggaagcttaatttattcattttagatctttctttttttctattaagaaatattatcaaatgctataagtttccttctactcattgcttttgctgcatcccataaattttgataagtagtattttcattttgttcaaagtacttgtattttttattattttattttattttattgagacagagtctcactctgtcacccacactgaaatacagtggtgtgatcttggctcattatagcctctgcctcctggggtaagcaatcttcccacctcagcctcccaagtagctgagactacaggcatgcgtcaccacactcagctaatttttatatttctttgtagagacagggcttcatcatgttgccaggctggtctcaaactcctgagctcaagtaatctgcctgcctcggcctagcagagtactgggattacaggtgtgagccaacatgtctggctgttcaaagtatttttacctttctcttgagagttctttgatttggtgttatctagaagtgtgttgtttaatctttaagtatttcgggatgttaaagctgtttttctgttactgatttttagttaaaattcattgtggtctgagagcagagattgcatcctttcaaatttattaaggtatgttttatggctcaggatatagtctgtcttggtgaatgttccatattagccggagcagaatttgtattttgctcttttgggatgaagtagtctataaatgtcaattatatccagttgactgatgatactgttgagttcaactatgtctttattgaatttttgcctgctgtctctgtccatttcggatagacaggtgttaaagttccaactagaaaaatgaaagttatctctttctccttatagttttgccagtttttaactcatgtgttctttttttaagaaaaagggtctggctatgttccccaggctggcctcctgggcttaagcaatcctcctattcagcctccagagtagctgggactaaagatgcataccaatgagcctggcttgactcacgtattttaatattcttttgttaggcacaaatacattaaggattgtcatgtctttttgaaaaattaacccttttattattatgtaatgctccactttattcctgataacactcattgctggaagtctgctgtctgaaattaatatagctaatttaactttctttttattagtgttagaatggaatatcattctccatctctttccttaatcaatatgtatcttgtaaaaaacacatagttcggtcttatttttgacccactctagcaatctctgtattttacctagtgtatttagaccattgacatttaaagtgattattgatatatttgggttaatatcaatcatgcttgttcctctttgctattcattgcccttctttgttcctacttttgtcttccattcttttcctgccttttgtggttttaattgagcattttatatgattcaattttctgttagcatatcaattatacttctttataaatttttgtaatggttgcctgagagcttacaacatgcgtttacaactaatacaaatccattttcttttctttttttttttcttccttcttttgcccaggctggagtgcagcggtgtgatctcggctcactgcaacctccgtctcctgggttcaagcaattctcctgcctcagcatcttgagtagctgggattacaggtgcctgccaccatgcccggctaattttttgtatttttagtagagacagggcttcaccatgttggccaggttggtctcaaactcctgacctcaagtgatccacccacctccacctcccaaagtgctgggattacaggtgtgagccactgtgcctggtcaaagtccactttcaaataatactatatggctttataggtagagcaaacactttataataatatttctaattcctccctcccatttcttgtattattgctctcattcatttcccttaaacataagctatagtcataaatacattattgctattattaatttgaacaaattgttatctattagataaattaagaatttaaaaaattttatctttgtgtatttcctttcgaatattcttccttttttacatagatgtgagtttctgatctacatcattttccttctctctgaagaccatcttttaacatctcttgcaagccaagtcaactggcacaaaagttcttcaatttttgtttatctgtgaaagtctttgtttctccttcacttttcaaggacagtttcacaggatacagaattctaaggctggtgttgtttttttttttttctctctctcaacattttaaatatttcatgccactctattcttgcttccatggtttctgatgagaagttggatgtaattcttacctttgctcttttatgggtagttttacctctgtcttctttcaagattttttctttatctttgacttttctgaagtttgaatatgatatggctaggtgtagtctgtttggacatttaccctgtttggtcttttctgggcttccagaatctgtgacttggtgcttgacattcatttgtggaaattcctagtcattatggcttcaattatgtcttctattcctttctgtcttccttttccttttgatattcccatttcatgtatgttacaccttttgtagtgaccccacaattcttggatattctgtttcattgttgttcagtatttttttctctttgcttttcagttttagaagtttctactggcatattctcaagcccggagattctttctcagctttgtccagcctactaataagcccatcaaaggcattcttcatttgttacagtgtttttgatatctggcatctctttcttacaattttcatcctgtttataatactcatctgttcttacatgttttctatttttttccgttagagatcttagcatatttaacataacttttaaattcacagtctgataattccaatataccctccatatatgagtctggttctgatgtttgctccatttctttaaactgtgttttttgccttttaatacacgttgtaaattttagttgaaagataaacatgatgtactgagtaaaaggacctgtggtaagtaagactttagtaatgtggtgataaggtgtgtgtgttgggggtggggagaaaattctatagttctatcactagatctcagtcttttagtaggcctgtgcctctgagctgtgaatgtcaaaaaatgcttttctggtttttttcactcccttagttggtgcaggatggttagaggaggccagagttggatattttccttcaactatgtggaaggctagaggaggctgactagagttgggaacagaacttctccattaaaatcttactatcagtttttatgaagttagcagtcttggaagtttagatcaaaaataacatcccagagacttccagtttccatttctacatgtaaggatattagaagtcatcactctgtcctaaaaacaaataaaaagctgaagaaactgaaaaatcaacaactcttcttagatccatcagatctaagttggttaggctctgataaaaacatgtgtaggttaggctctgataaaaaatttttttttggggggcagactttgtaagaagaacagaatactgtggtatatttcacaatggttaccctcctctttccttgatactttccctctcctcctgctggttggctgcagaaggtaaaacttaaaaaagtgtgggcctctcccatcccataattggggacctcctcgacttttccacacagagctttagccaagttttaaattacaattcaggtttttgtaccctgctcctggttcccaaagaggttttcattcctgtaagttatgattctctgaatctgtctaatcactcctattttttgggcagcagtttgccctgtgactcacttctctgatggatttaagaagaattgttgatttttcagtttcttcagctttttatttgtttttaggacagagtgatgacttctaatctccttacgtgtagaactggaaactggaagtctctgggatattatttttgaaccttaaatttccaagactgctaacttcataaaactgataataaaattttaatggagaagttctgtccccaagattacttaaaaatcatagttggacatacaagaaaactttaattcatttaaagaaaaaaagcttcataaaaatatattagcatttttgttaaaagtaggctgaaaagaaacaaaaaggaataatatcttaagctctaaatctactgtcctagactatccatttatttgggatgaagcaagccattccccaaatgaggtatgcaaacagtatgatattaaatgtgatgagactgatttctgtgtgcatttgagagtttagatttcttatttaaatttaacttgtacacatgtggtattggtgaattaactattatttatagaaaaacatgttgttctatttccttttattatccaaactctatgcagttttaagaaattattttgttgtttcattctgcttacacatggttgtacattacttattccatgatgcggcagagtgggattactaacagtggcatgttctaagcatacccagagattgagattctatactttgtgtataaaggaaacagtgtgaatgtagggagtgtgttgagagagagggacaaacagagagagattgatttcaaaaaagagagtgcaagaatatgcacccctaaatagaaacacagaaaatctccttttcctataaatgtctccaaaactgcaaaatcaaaaatgaaagaaaacaaagggggaaatgagttatatctaaacctgcagttttagttctgatgttctagaactcctcaattagttcctgagcaaactgtagtccacactcagtgaataattttggtaaataatacatttccctctcttccacagaccctggccctactcctaataactgctttgtagaaatggcctactaaatagaccaagtcatgggaacatatgtatatttacaaaggagtccaatcacttacactggcagatgaggactattcaagttcacagaaaactttgattcaaggccatcaatatactgacgtaaattaaaaagcaacctttactaatgaaaaaaatcaatgaataaaatttgcttcaaaagtttaaagttagcaagcagcaaataagaaaataaaaatttaaaacttcaattacttgtgcttcatcatttttaatcaattttttgttctctatagggaacaaaattctatatacttctggaagccaaaatctctttctctcataggtttaatcaaacagaatatttagaaaaacatacacaagaaaatctctttataagtatttgctgacaacaacactatgctttaaaattgtagtgggaaagcaagtgttatacaactttttacaaggttgctgctgttttaaaacttagggcccaattttaataagaaacataattatttccaaaattataatgttctttctagctaacttaaaactaaatgtcaaagtaggttttaaataaaatcctttaatcaatgatgtttctaatcccaaaaatttaacataaaaaagtatgacaaatattaaaacatacacctcctaggcaatattttgtttttgtttttatctttgaaagattcaagaaaatatttcctctttgttcacatattgcttgtaacaaagctgatcatctgatctggagtatattgattaagtagtgtctttgttgtctcatgttttaatatttatcaaacatatttctcatcttctcttcatttacattttttgtttcacataccatttgtaataattacattcaatactcctcttagaggacaagaaatgtatgtctccttttttgtctgtggttttatttcttctgtatctgataagacagttttagtttcttcctgtgcagtattattaggatcaatgagactctgtagtaaaacaagaaaatctttaaggaaccatactttctgtataattttatgaatgaaataaaccaccaaattttagaattaaatttatattattactgtcaatgcgaggaatcacagatacaaaagaagattcatgctccatatcagtagctgtttggggatgtaacagcagtgtattttgcaaggtaccttgattgaaccttttatagacttgggtccccactattttcaatcatttgtgtatactgaataaaggtgcctacagtttgggcacaataattaaaagtgtccatcctctgtatacatcccaaagattattcaccaaaacttttgtgaaatgaaaatacaactcaattagaaaggaggtgaaatataattttacttggattcatctcatttgataaatttatataactgaaagaaaaatgagaaaaacataggtcaagccttcggaaattcaagcatgcttccactaatatttatagataacatattaaatagtgcaagggtataccttaatctcccaggccttttaatggtagcctgattatgaaactgctgattttgaaaaaaaggaatctttggtttgtgagaatattgagaaacttcttccaatgtaaaaaacaaaacataaacaatgataacaacaacaaaacaccagagtagagttaactctgcagtagaaatctccaaatttgccttatgattgtcatgggtgggtgggtgtgggggtgtgtgtgccagcaatttgagtgacttgataatactttgagtgagtgaaagagggaacatcttatcatcacaggaaacaataaaaaggctagagtgcatggacacattgaggaagggaattttacatgtaatgactaaggagacagagatatcaaggcagctgatggttaaaaatgaattatgtagctctttaagatcaaagttcttcaaatctgatcataattaacctattggagttctggtatagaggcaggctttttctgaaaattctgttactatataaaagggataaagacacaatggtgaatttttattaaggtgggtgaaaggtcatgtagagtaaaaccatattattttaagttttattattttagaatttgtaataaactgatgtagactaagatgacttcttcacagataattagaatcaatggtgaatatttaaaatatttttaaaaatgactttttgacccttaagaactgtagaaatctctattttaaaaaaatacgaaatttacaattctaattatgagcaattattactaagtaaaactagatcaacaaaaggtctaacgacttgctctatatatctataaaaataaaaaacttgggtctcttcaaaacacacagcacaacattttaattaatctagacttatctttacctctgttagtttaagttactgagttttccctgaatgtggtgagaaataataagcgacatttcttcttattcctaaaatctgtgctctttagctccaaaatgctctatagtcacacctttccatttgtttcattatttctgctcatttcctaggacccattacaactagctattttaaaatttaccacttttcatttttaaccagatatataaaagaaacctatctaataagtaaattaggaataaattttaagatcaggttgattttatatcatatattacagtatacttttaagtttttacctgaggagttgtagatgtttggaagttttcatcctccaaatgttcattttttgattctgtggtatgcatgctaagatttaaaagaaaaatactttaaaagaagaaacaagactataaatccatatgaaaacaaacatggttaagtgggattaattttttaaaggattttttgttctaaagttgtatcacagtcaagtcagatatctttatagtcaacatagatccaaatattcatctttaacattattaaccaaagccatatgcataagttttaaaaaccattatcatacagaaatgtaatatttctcaacagttcataatgctggcccatatcatagaatcatgtatcagaaaatgcagaaatttattttatgcactgaactggtgtgtttgagttaatatccactgttgatttaatctatcttctgtcatgctcttacataaaacactccagaaaaattttaaatgaaatatgaccaactacattaatacctacatctataagttactgatacatactatctttttatgtggcccatttgaaggatctgtaggtccaacatttaaatatatctataaagttttattttgaagaagaataaactagatgaataaaataataattacttataacttttattttaaagtatctgttgtttctacctcctctgtaatctttgctagcttcaaatataagtagggtaacttttcttaaaaatatcttctctcaatttttgagttgttgttaagaacaaaactaaagatttcaagttttaatttttagatagtcttattaccatatcctgtagtgcttcaagtatctatacttttctaaaaggaaaacaattttaataatgaaaattgttaacgaaaaggaacattaacagttgagtagctaccatatgctagctgctttacatctattgtcttaccataatgaagtaaaatattactgcataaaatcctataaagaatcataactgaatttataacattattaaagcaaaaaataacctttaaaaattttgatcagaaacttagatctaaattcctttaaagtgtagttccattttgattgaagtgactgtcaaaataactatcttgtcattagaatgatgtattagtccattttcatgcagctatgaagagatacctgagtctgggtaatttataaaggaaagaggttgaattgactcacagttccacatggctggggaggccacaggaaacttaaaatcatactggaggggacctcttcacagggtggcagaagagagaatgagtgcaagtaggggaaatgccagacacttataaaaccattagatcttctgagactaactcacaagatccagctacctataccttgtcccacccatgacatgtggggattgttataactcaaggtgagatttgggtggggacagagacaaatcatatcattctgccccggcccctcccaaatctcatgtcctcacacttcagaacacaattatgcctttccaacagtcccccaaagtcttaactaattccagcattatctcaaaagcctaagtccaaagtcttgtctgagacaaggcaagtcgcttctgcctatgagcctataaaatcgaaaggaagttggttacttcctaggtacaatgagggtactgggagaaattggccaaaacaaagaggctacagaccccatgcaagtccgaaatccaatagggcaatcagtaaaccttaaagttccataatgatctccttttactccatgtggcacatccaggtcacgctgatgcaagaggtgggctcccatggccttgggcagctccgcccctgtggctctgcagagttacagtcccactctctggtgctttcacaggctggcattgagggtctgctgcttttccaggcacatggtgcaagctgctggtggatctaccattctggggtctggaggatggtggctctcttctcacagctcctccaggtagtgccccagtggggactctgtgtgggggctccaaccccacatttttcctttgcactgccctagcagaggttctccatgagggctctgccactggagtaaacttctgcctggatatccaggcatttctatataccctctgaaatctaggtggaggttcccaaagctcagttcctgagttctgtgcacctgtcggcctaacaccacgtgtaagctgccaagccttggggcttgcaccctctgaagcaatgccagagctgtacctggcctcctttagacatagctggagctgaagcagctgggatgcagggcaccatgtctcaaggctgcatagagcagggtgaccctgggcctggcccacaaagccatttttccctcctaggtctccaggcctgtgatgggaggggctgccacaaaggtctctgaaaatgccctggagacattttccccattgtcttggtgattaacatttgactcctcattacttatgcaaatttctgcagcaggcttgaaattctacccccttccccagaaaatgtttttttttctattgcatcatcaggctgcaatttttccaaacttctatgctctgcttcctcttgaacactttgccacttagaaatttcttctgccagatatcctaaattatcactctcaagttcaaagttctacagatctctggggcagaggcaaaatgccaccagtctctttgctaaagcatagcaagagtgacctttactccaattcccaacaagttcctcatctccatctcaaaccacctcagcctacacttcattgtccatatcaccatcagcattttggtcaaagccattcaacaagtctctatgaagttccacactttcccacatcttcctctcttctgagccctccaacctgttccaacctcagcttgttacccagttccaaagtcgcttccacatttctgggtatctttataacagcagcccactctgtggtgccagtttacattagtcctttttcacgctactacaaagaaatacccgagactgggtaatttataaaggaaagaggtttaatggactcacagttccacatggctggggaggcctcaggaaacttacaatcatggcagagggcagctcttcacaaggcagcaggaaagagaatgagtgaaagcaggggaaatgccagacaattataaaatcatcagatctcatgacgtgatcacatcagatcactcattatcatgagaacagcatggggaaaccacccccatgatccagttacctcctcattgttccacccctgacacatggggattattacaattcaaggtgaaatttgggtggggacacagaatcaaaccatatcaaatgactaccttgtcataagctgttagattatgaggtaattggtaagaataagggaggtaggtgaatcacctaagttgtgtcatgttctgaatagacagactgggagttagagccattaaaaagtttgagctgaagtgcacataaattttgaggagaggacacaaaattaatttacacacttaataatttttgaatgcctactcttctggcctctgaaggcaaagcagccaatcaaaacaaaataaaacagaaatataggcttctgttctcatggatcttatactcttgttaggtggaaggggaagattataaaaaacattttcagtactgcagaaaataaatgaggatcatattatagagatcaaggtgacatttgaactgtgtcctaaatgaggagaagctgtgagtcataagtaagcagatggacaaggagcaggcaaacataacaccaagaatcatacaaatggagacatcaagcgactaggcagcatattttaagatatgtaactataatgattaggatagcagggcttggaacccaggcaagcagactatgtattagaacttcaaaacctaagtaaggggtctgaataatagatgcacaggttaatagctataagagaagctttatactgagtcaagcaatatttgtgactggcagtcactcaataccctctttatatatctgccaagagtggaattggtaggtggtatgcctaaaagcaaggactttgagttgagaaagaaatgtattcaactcttctcttatcttttcataactgtgggaagtgatttatctccactggcctcaatttccttatctgaaaaaatatataataatgcttagtttattggttatcataataattaaattataatagctaatgccagttgaactatattaagcacttaacatgaatcatcttcctcaattctctcaacaactctatgaggtatttaatactattatccccattttatagatgttcaaactatggatgcaggaaagttaagtaatttaactttcaatatggtcatataactagcaagtggggagctggaatttaaatgaagtactctttaatattactcagatctttgtcaactttagtattgtctcttttttcttttaactgttgtggtgacattgcattatgaatttaaattgcatttctataatgagcattttttcatatatttactggccatttgaatatcttctttagtaaagtgttcaaatctcttgtccatttttttgttgtactggatcccattttcatactgatttgttggagttctttttaggtattaaaaatgtaaatcttttattggatatataaagagccaatatcatctcccactctgtgtcttgcttttttacgctgataataccttttttaaaagatactttaatttggcccaatttattctttcctttctttatccttagagcttttgttgtttaagaaatctttgccaacccatgtaggagaatgtttattctcctatatattcttccacaaacattattgttttgcttttcacataggaaaggaacaacaacaggtctatggtctatgagccatctggaattgaatttcatatatgggatgtgaggaagagatcaaagtttatttttcccatatcaatatctaattgactcagcacaatttattaaaaatatcatcctctatacattgtattgcaatgccacttttttttgtaaatcaggtaatcacacatatatgaatttattttcatattctatcctgttccactggcccatttgtctatccttaggctaacattatgctagtgcttgtatttttttttctgagatagggtcttcctctgtcacccaggctggagtgcagtgacacaataatagctcactacagcctcaatctcctgggctcaagtgatcctcccacctcagcctcctaagtagctgggactacagccacaagccatcatgtccagcaatttttttttttttaaatttttagtagagtcgaagactcactatattgctcaggctggtctcaaactcctgagctcaagcaatccttttgtctcagcctcccatagtgctgacaggcatgagccattgtgtctggccagtataacagatattgacatctggtgttggtgtacattctccacttttgttgttcttcagaattggattgactttttgatcctttgtatttccacatacattttaggaccaagttgtcaatttacacacacacagctggaattttgactgaagttacattgaatctatagattaatttggggagaactgacatcttaacaatattgagtcttccaatctttgaacactgtatattcctccatttatttagattttcttgatcttaataattttttgtgttttcaatgtacagaacagtatgtctttcattaggcttatttttaggtattttatgttttttggatggttataaaaattataactttaaaaattcattatttgtttcttgctggcatacagaaatatgaataattttcattcatttcactttgtatcaggccttgataaattcacttaattctaatagtctgtagatttgtttggattttctaagtacatacatacacagtcagcaaatataagttttatttcttcctctctaaattttatgtatttttctccctttttctttgtttttctggctttaacctgctgttacagttgttctaaatcattgctaaccttggtattgtctgtcttcagaatttgttttaatatagatctgttggcgataaattccttatttctttgcctgaaaaatatctatacttaaccttcacttttgaaagtgattcttattagatataggttagagtttattttctttaagtactttaaagatgttccactgtattctggctcccatagtttctgttaaaaatttaactgtcattcttgctatgattcctttgataataataatatcttttttactttggctgatactaatcacaattattttaagcaattttcctgtggtaaaatatgcataaaatttaccattttaaccactttaaagtatatagttccaggggcattatgtatatttgcattgttaagcaaccatcaccaccatccatctccagaactttttcattatcttgacctgaaactgtgtatgtattaattaaacaataacttcccattctcccctcctccaatccctgatagccaccattctcctttctgtctctatgaatgtgaatattctaggtactttatatgattcaagtcatacaatatttgcccttttttgtcttgcttattgcacttatcatgccttcaaaattcatccaaaatttattcaaaattctgtacatgttgtagcatgtacagaatttccttcctttttaaaggctgaataatatgcatttatatgtatatatcacattttgtttatccattcatctactgatagaccttttggctattgtgaataatgctgctatgaaaataggtgtaccaatatctgtttgaatccctgatttcaattctatttggtatatacctggaaatggaattgatggatcatatggtaattctatgtttaatttttggaggaaccatcatcatatggttttttttttttcacagcaggtacatcattttatattgacatcaacgatgcacaatgattccagtttctccacatgcaggcaaacacttgttattttctgttttttggtaatagccatcccaataggtgtgaatggtatctactgtagttttcatttccacttccctaatgattaatgaggttgagtatcttttcatgtgcttactatttgcatatatcttttttggagaaatgtctcttcaagtcctttgtccatttttattcttatttttttgagacaaggtctcattatgtcacccaggctggagtgcagtggcacaaacatagatcgtgcagccttgaactcctgggctcaagggatcctctgcctcagcctcccaagtggtaggactactggtgcacacgtccacacccagcaatttatttttttgtatagccagggtcttgctgtgtagcccaggctggtctcaaactcccagcctcaaagtgctgggattatgggcatgagctattgtacccagcatctttgcccattttaaaattgggatgtttgtttttttccgttgctgagttgtaggagttctttatatactgtaggtattaatatcttattagtaatatgcaagtattttctgtaagttgccttgtcactctgttgatagtgtcctttgttgcacataagttttaaatgttaatgtagtccaatttatctgtttttccttttgttgcctgtacttttggcatcatagccgagaagtaaactgccaaatccaatatcatgaagctttccttctatattttcctttaagagttttaatatttttagtttttataatcgtagttattgtaacctctttaactcaaaaatctggatcccttttgagtctgtttcccttttcaattttctatcttggcttaaggtcatataacattgtctaatactatggttcacaatttttattgaaagtttgacattgtgtacaaattgtacagtctccagatgataacttcttttggaaagaaatatgtggagtagggggagtgaaaaaatcactttaaccaaatcagagattgagctcagttgatagctttgtaatgctcagttttatttcaatttgtccttgttcctcaagtatagtcctttagggattttgccctaggtgatttccttgataaattatggcagtgtcacttgattcctcccatatcaggcattgtattattctgttttcacacttgttctataaagaactgcccaagactgagtaatttaaaaaggaaagaggtttaattgactcacaattcaacatggctgaggaggcttcaggaaacttacaatcaagtggaaggtgaaggagaagcaaggaccctcttcacatggtggcagaagagagaagtgcaagcaggggaaaatgccagatgcttataaaaccatcagatctcatgagaacgcattcactgtcttgagaataggacgagggaaactgcccccttgatccagtcaccttcctcccttgacacatggaaattacaggtctcttcctctacacatggagattacaatatgagatgagatttgggtggagacacagaaccaaaccatactgttctgcccttgccctcccaaatcgcatgtcctttatacatttcaacatcaatcatgccttcccaacagtcccccaaagtcttaactcattccagcattaactcaaaagtacaagtccaaagtctcatctgaggcaaggcaagttttcaaaaccaatcatgccttcacaacaatcccccaaagtcttaattcattccagcattaactcaaaagtccacagaccaatgtctcatctgaaacaaggcaagttccttccacctatgattctgtaaaatcaagagcaagttagttacttccaagatacaatgagggtacaggcattgggtaaatattcctgttctagatgggagaaattggtcaaaacaaaggggctatgggccccacgtaagtctaaaatccagtgggggcagtcattaaaccttaaagctccaaaataatctcctttgactccatgtctcacatccagggcatgctgatgtaaagggtagactcccatggcctagggcagctctgcctctgtggcttggcagggtatagctccatgcctggctgctttcacagctggcattgagtgtctgccgacattacaggggcatggtgcaagctgtcaatggatctaccattctggtgtctggagaatgatggtcctcttctcacagctccactaggtagtgccccattggggaccctctgtgagggggtccaaccctacatttcctttccacactgccctagctagaggttcttcttgaggctccacccctgtaccaaacttctgcctgggcatccagtcatttccatacatcttctgaaatctaggtggaggtttgcaaagctcaattcttgacttctgtgcacccatgggcccaacaccacgtgtaagccaccagggcttggggtttcaccctcttgaagcaacaacctgagctgtacattggcccctgttagccatggctgggatgcagggaaccaagtcctgagagtgcacaaagcagcaaggccctgggcctggcccacaaaaccactttctcctcctaggcttccagacctgttatgggaggggctgccatgaagatctctgatattttccccattctcctcattacttacgcaaatgtctgcaggcagcttgaacttctcccccaaaaatggatttttcttttctattacatggtcaggccacaaaatttgcaaactcttatggtctgtcacctcttgaacgctttgctgcttagaaatttctcctgccagataccctaaatcatctctcttgagtatgaagttccacagacctctagggcaggggcaaaatgccagcagtctctttgctaaagcacagaagagtgatctttggtccagttccaataagctcccatctccatttgagaccacctcagcctgaaattcagtgtccatatcaccatccagcattttgatcaaaaccattcaacaagtctccaggaagttccaaactttctcacatactcctctattcttctgagccctccaaactgttcccacctctacctgttacccagttccaaagtcacttccacattttcaagtatctttatagcagtaccccactcttcacagtaccaattttctgtattagtcccattttcacactgctataaagaactgcccaacattaggtaatttataaacaaaagaggtttaactgactcacagttctgcatggcttaggaggccacagaaaacttacaatcatggtggaaggcaaaggaggagcacggaccttcttcacatggtggcaggagagagaagtgcaagaagggaacaggccaaatgcttataaaattatcagatctcatgagaattcactgactatcttgaggacagcatggggaaaactgcttctatgatccaatcacctctctccctcaacatgtgggcttacaggtctctccctcaacacgtggggattccaattcaagatgagatttgggtggggacacaggcccaaaccatatcaggcataccttaccatttcctaacttggtttatttctactgtccatactttcctatattggaagagctgaattaacatcttcaatgttacataactataaataaaggagttggagcccatcaggcagtctgactccagagcccatactcttaaaactaaactgcttataatgtgacaagtattctgtgcaagacacagactaaagctctcataagaatttataggctaacatttagaaaatgctgtaataacttaaatctataaaagattaaatgatctaccaagaaaagagaaaaaaatccaacaactatatgattttttgacttttccattttagaaaatgaactagtacgagtaacttctttaggaagtaaaaaagagtcttaagaaaaacttaaaaatagaaaataaaggatgaataagtcacagaaggctaaaatggtttagaaatagcccattggaaatcaattacaaagctgttcagacccttggggattatgccaataatgctattccattgcctctgagcagccctatccatggtccttaactctcgagtgctttcactgaacactctggaacttctgccagatgattatcaaactgtattatattctcaacctcttttcaaagcattctctcaaattctgtgccctatatgaaaccaagcccttcctttaaggaggacactgcttcccctatagtcctctcacataacagcagtttattcactaacattccttctgacaccctactgctatttctaaaacttcttatataaaaaagaaacaaaatccttgcttttttaaagcttgtataatttgacaatatcaccttcctccccttctactcactgttacttactcaccttattttgatccctttccattattcaccaaagatgttggtgcttgacccccatatttgtaatcttttcatcttacacacttggataattcatctactatcttgtttcttcagttctttacttcctttctaataaaggaaagaccacactaaaaccttctatcatctgaaatgctctattatcgataatcatgatttcaagcatctacatctctgaatactacttcatcttctttcagttctcttgttcagttgtattcacttcatcccctccaattattcttcactttcatcaggatgtgcagtgtaatgaaccctgtaactcaaacttttgccctcttccttctttacctgtttttgtattcaatacctgtgatccatcatcctcaaaatactgctataaatatcttaaactatcttgaaatatctttgttgcttcattgttgcacatttgtagaaacacctcaatctagggatgctgctgccctacttccactgatgcccctccccagctgacacacatgcacccttttgcactgctgaggcagctggcatgtgtgagcatgcaaagatcctcttgccactaccccagtgaagcactccaatgggggtaattccccattggagtactgtggcagtggactaggaataccttggctcctgcagcacagcaggttcctaaccttgaggggccagagaacagagctaggggcctggtttcagccccccagagctacagcacacagctgaggagagctcagctgagccttgaccccttaaaatcttccagaaatgaagccagccaactgaacccaccttataccacaaccaaacccccaagggcatcaaagaagataaaagcaaaaagccccatctataggacaacaacttaaatgttgaaggaacatgagcccacacagatgagaaataaccagcacaagaactctggcaactcaagatgcccgagtatcttcttacctccatatgaatgtagttgttcctcagcaatgattcttaaccaggctgaaatgacagacatataattcagaatatggatagaaatgaacattgacattcaggagaaagttgaaccccaatgcaaggattctaaggaatacaataaaatgatataggaacttaaaaatgaaatggccatttaagagagaaccaaactgatctgatagaactaagaaactcactacaagaatttcataatacaaccacaagtattaacagcagaatagaccaagctcaggaaataatctcagagcttgaagaccatttctttgaaacaactgtcagacaaaaataaagaaaaaagaacaaaaagaataaacacctctgagaaatatgggattatgtaaagagaacaaatctacaactcatctatgtcccagaaagagagggagaaagagtaagtaatgtggaaaacatatttgaggatatcatccatgaaaatttccccaatcttgctagagatgccaatattcaaattcaagaaatgcagagaacccttgtgagatactatacacaatgaccatccccaaaacacaaagcaatcagattctccaaggtcgaaatgaaagaaaaaagcattaaaggcagctagagaaaagaggcaggtcatctacaaatggaaccccattaggctaagagtggacctttcagcagaaactctacaagccagaaaagattgaggggcctatattcagcattcttaaagaaaagaaatttcaaccaagaatttcttatctagttaaaagaggcttcataagcagaggagaaataagatcctttcagacaaacaaatgctaagggaatttgttaccaccagatgtgccttacaagaggtcctgaagggagtgctaaacatagaaattaaagactgttaccagccaccacaaaaacacacttaaatacatagaccattgacactataaagtagaaactacacaatcaaatcttcataataaacagctagcaacatgatgacagaattaaatttgcatatatcaaagtatcaactttgaatgtaaatgagccaaatgccccaattaaaaggcacagaatggcaagttggataaagaagcaagacccaacaatatactgtcttcaaaagactcatctcacatgcaatgataactataagctcaaagtaaaggaatagagaaaaatctaccaagcaaattaaaaaaaaaaaaaaaaccagaaaaaagcaggggttactgttctaatttcagacaaaacagactttaaacaaacagtgatgaaaaaagatgacaaagaaggacattacataatggtaaagggttcagttcaacaagaagacctaactaccctaaatatatatatgaacccaccacagaagcaaacagattcataaaataagttcttaaagacctatgaagaaacttagataaccacatacaagcagtgggaagtttaaacatcccattgacagtactagacagatcactgaggcagaaaactgacaaagatatttgggacctgcactcaacacttgatcaatgaacctaacagacttttacacaacttgccaccccaaaacaatagaatatacattattctcatctgcacatggcacatactgtaaattggccacatgatcagccataaaacaattctcagcaaatttaaaaaaactgaaccacactcttagaccacagtgcagtaacaatagaaataaatactaaaaagaactctcaaaaccatagagttacatagaaattaagcaacctgtttcctgaatgacttttgggtaaacaataaaattaagtcagaaattaagaaattctttgaaactattgagaacaaagatacaatataacagaatctctgagacagggctaaagcatgctaagagaaaagtttatagcactaaatgcccccatataaaagttagaaagatctcaaattaacaacctatccttacggctagaagaaatagaaaaacaagagcaaaccaaccccaaggttagcagaagaaaagaaataaccaaaattacacctgaactgaatgaaattgggacatgacaagcaatacaaaaagatcaaggaatccaggagttggttttttgaaagaataaataagattatttaaagaataaataagattataaataagaacaaataagattatttgaaagaataaataagaccacagctagactaacaaagaaaaaaagagagaacatcccaataaacacaattggaaatgacaaagggacattaccccagagaaatacaaaaaatcctcagactattatgaacacctctatgcaaacaaattagaataactacaagaaatgggtaaatttctggaaacgtacaacctcccaagattgaaccaggaagaaattaaaatcctgaacagacaaataatgaattctgaaattgaatcagtaataaaaaggttaccaactagaaaaagcccaggaccagaatgattcacagccaaattctgccagatatataacgaagacctggtagcattcctactgaaaatattccaaaaaattgaagaggaagaactccccaagtcattctatgaggatagcatcatcctgatacccaaacctggcagagacacaataaaaaagaaaaaggccaatatccttgatgaacactgatgcaaaaatcctcagcaaaatactagcaaatggaattcagcagcacatgaaaaagctaatccatcacgatcaagtagactttatccctggcatgcaaagttggttcaacatatgtaccaataattgtgattcatcacataattagaactaaaccccaaaaccatataataatctcgatacagaaatggcttttaataaaattcagcataacttcatgttaaaagccttcaacaaataggcatgaaggaatatatcttaaaataatgtcgtttatgacaaacccatagccaacatcacactgaacaggcaaaagctggaagtattacccttgaaaaccagagcaagtcgaggatgccctctttcaacactcctattcaacataatactggaagttctagccagaacaatcaggcaggagaaagaaagaaaaggcatccaagtaggaagagaggaagtcaaacaatctctgtctgtagatgatatgattctacacctagaaaaccccatagtctctgcccaaaagctcctagatataaaaaactacagaaaattttcaggatacaaaatcaatgtaccaaaatcagtagcatttctatacaccaacaagtccaagctgtgagccaaatcaagaacaagattccatatacaacagccacaaaaagaaaataccctaggaatacagctaaccagggaagtgaaggatctctacaatgagaattacaaaacactgctgaaagaaatcagatatgacacaaagggaaaaacatttcatgctacagtatcttggcatcactataaatgcataacagccttgaaatcagaaatatactggttgtatgatcttgggtaatttacaatctcttgtcatcttttttttttttttttttttttctggagagatgggttctcactctgtctgtcacccaggctggagtgcggtggtgtgatcatggctcactgcagtctccaactccccagctcaagtgatcctcccacctcagcctcccaagtagctgggactacagacatgtcatgtctggttaattttttgtagggacggggtctccctatgttgcccaggctggtcttgaactcctgggctcaagtgatcctcctgccttggcctcccaaatctcatcagcttttattgggcatagtactatctgtttttcttcatattcacagctagggaaagcagaatcacatttgaggacagacacccaaatatgagttgactggataagtttattagaaattatggcctgctttttgtactaacaaaaataagacttcttactggtttatattccagtgtcttacatataaatgatcagctcagtttaaaaaatttttatgctttacttatttcaataagcttcttaaaatccttttcggaatgaggtagatataagtacatacataaacacacatatatacatatcttgctattatgggaattaagtgagatgtttgtacaacttatagcaaaagctatggtatttaaaacttattagaagtctgtactgctgttatattgctaggctttgctttcaaaatagtgaaaaattttgatggatttagaagttccattttcaccttggttttttagaatgtctgtttgattatatattaataatggacacagtgtggtattgtaaaaagaactgggcaatctaagttctctgtttttcatttgctacttttttttttttttttgacagaatctcaccgcccaggatggagtgcagtggtgcgatctgggttcactgcaacctccgcctcccgagtagctgggactaccgacgtgagtcactgtgtccgtctagtttttttattttttggaagagatggggtttcaccatggtggccagaatggtctaaaactcctgatctcaagtggtccgccagcctcagccttccaaagtgctgggattacaggcatgagacatcgcacctgaccctgatacatcatattgagtaaatttcttgtcatttcatctctctgctcgattccaaacctataaagtgacgtagggagtgaggatcttagatgatctaagggctttaacagtttcttttttttttttttttttttgagacggagtctcgctctgtagcccaggcgggagtgcagtggcgcaatctcgactcacggcaacctccgcctcccgggttcaagcgattctcctgcctcagtctcccgagcagctgggactacgggcgcgtgccaccacgtctggctaattttttgtatttttagtagagacgggtttcaccgtgttagccaggatggttttgatctcctgacctcgtgatccgcccaccttggcctcccaaagtactgggattacaggtgtgagccactgcgcctggccaggctttaacagttttaagtctatgattctattatctgaggggcataccaagaaataggctgaaagaatagcaatacgtacttcttgggaacttcatttcttaaataccatgtatgtgcatatgtatcacttaatataaacaacttgtctttccttggtgtgtccatacacaatactatgggtttatgcttttggagcaatgttgtgcaacagtgacatctagtgactacatatcacagatcattcagcaaaactttatggccaacttgtactcttctaaatgtggatgatttactttgtagcccagctaaatacttttaaataattcctcacctctctcctctaaagaaaggtatgccaattaaatttgacaacagcattaataattggctaaataagaactgaaatttcctttaaaaatcataatgtatatggaattcagtataaattattctaaatgagactgcagctcttttccttccactgagagtggcaaagctgggattttcaattccagtgtgtttaaatatagtctattctcttatctactatgcattgctgacatgtagtaggcatttaacacatacttattcaattaatgttaggtaaaacatatgcatcaacagttgtgagtatgtattgctttggaatctttggaactattgctgcctttcaaacaaagaactcttcttgaggtcagataaaagattaacacaattataaacaaccacagtatacatctttctgaacaaatgaatttgagacctacatgcatgcataacagaatactctttataaaaggcattcaaactaggtcagtattttttttaagataatgactacctagtattattatttaatcaggacaatacaaatctgggctaaacttctactactataattcaaattgactgtcattgttaaaattcctaatagtatttaggatttgatctcattagtcagatagtaccttgattttaaaccgttttcgggtgcctagatcttgttgccacaataaagtgacacggtgtctgtcttaggtcattttgtatgctgtaacagaataccacagattggataatttataatgaaaaaaatttctttctcatagttctggaggctgagaagttcaagatcaaggcaccccagcatcttgagagggccttcttgttccattctctggaggggagggagtctatgtcctcctcacatggcagaaggtataagggtaagggacgcaaatgggtggcagaacttgtccttttataatgaaattaacctcacccatgtgggcacagccctcaaggcctaataacctcttaaaggtcccacctcttgatactgttacaatcaacatgagttttggaggggacaaacattcaaaccatagtagtgtcttagtctatttgtgttgctttaacaaaatcctcaagattgggtaatttataaataacaaaaatttattttgtcacagttctggaggctggaaaatccaagatcaaagtgctgacagatttggcatctggtaaaagctcagatctctgcttccaaaatggtgccttgaatgctgcatcttctggaggaaataaatgctgtatctttacatgttggaagagacagaagggcgaaaaggggctagctagctccctccacttattttataagggcattaatccatttatgagggcagagccctcatgacctagtcacctcctaaaggccccagctcttaatactgttgcattggggattaagtttcaacatgaaattggagggacacaaacattcaaaccatagcattttgccccttcccccacaacaaattcatgtctttctcacatataaaacacacttgttccatcccagtagctccaaaagtcttaactgtttccgataccaactcaaaagtccagagtccagagtctcatctaaatcagatatgggtgagactcaaggtttgattcatcctgaggcaaattgctctccagctgtaagcctatgatatcaagcaagttatatcattctaaaatacaatagtgggacagacagaggaaagatagatattcccttttcaaaagggaggaaatagaaaaggagaaaggggtaataagttccaagtaagtcccaaacccagcaaggcaaacaacattaaatcttgagacttgagaataatcttctttgactccatgtcctgccttctgcatacaatggggaaggggttgagcccccatgtctcctgggagccttgcctgcatggctttagggggagcagaccatgcaccagttctcacatgttggcatcacatgcctgtcgctctcccaggcaggaattgcacactggtatctctagtggcctacagtcttggtggtggctctgcccccatagctccactaggcattgctcttatgggggctctctgcggtatccctgactccacagctcttgtaggcactgccctagtggtgactctctgtgctgacctcacacctctggcagttctgtgcctgggccccaaggttctctgtgacctcctttgaaatctatgcggagatagccatgactacagacttagcaccacatgggcaccaccaaggtttactgtttatactctctgacactgcacctgggcctgcttgagccacagctggtgtggctaaggaatgctgagccacatgtgtggagcagaaagttgacgtggccctaggcagcaagccctgagttcccatggacaccctgggcccctcccttgaaactgttctgccctgaaggccctggcactctgagcctgtgataagagtggtagcctcaaagatctctgaaataccttcagggccactcctccactgacttgatgaataacatctggcttccttccatccatactaatctgcttatcaaacatgcacttggccatattcttggtattctctcctgaactcagtctttacaacctggttaggctgaaaaatttccaattctttaagttctgcttcctttttgattataaattccatcttgaattaatttttctctttttgtccagtatcataaacagtcaagagaagcatgtagcaccctcagcattttgtttaggtatttcttcccctaaatatcctatttcattgctcacaggttctgcctttcacaaagcattaggacacaggtggaattcagccaagttctttgctactttataacaaggatgacctttcctccagtttctagtaagacattctttatttccactgaagaactcatcagaatggtctttactctccacatttctaccagccttctgatcatgattaacttagataatctctaagaacatgaaggctctttatacagctctcctcgtcttctgaaccttcatcagaattgcccttaatgctctgttcatggtaatctagactttttctaggaggcacttcacaactgttctagcttttattcactactagctacaaagctgcttttacaataataggcatttgttataggaacactccacttcttagtaacaatttcttagcccattcctgctgctatgccaaaatacttgagactgagtaatctataaataacagaaacctactttctcacaattctggaggctgggaaatccaagattaaggttcagtcaggttcagtgtctggtgaggtctctgcttccaaaagggtgccttgaacattgtattctctgaagggaatgaacattgtgtcctcacatggtggaaggcatgtaaaggcaaaaaagtcctagctagctgtccccaggcctcttgtaaggacttttataatacattcatgagggcagatccctcatgacctaaccatttcctaaaggcctcacctcttaatattgttgcattggagattaagtttcagcatgaattttggaagagacataaacagtcaaaccatagcataaaccattccaggcatgttttatattcttttctttctcttagcaccaaacacaatggtttttctcaactatagacaaagctaccaaaaacttacccagaatccaaggtttgctatacatggaatcaaactgtctcaccagctttctttctggttctttcttttgacccaacatttcagtcaaactgttaactgcactccatgcctttatttggttggaacatcttcccactgaacctctttgtaaatatccattgattattctaaataaagcttcctgcaatgcacactacataaactggatgtgtttttccccttttgaattctcacatcattttgttatttgctctaccatccttacctctctggtgtcctttctttgtctttgttagtggtttctttcccctattcatcctttaaatattgggcttcctcagaattcttctctatgccctattctcttctcactctatatacatttctcaacatctattctactattatggctacaattctaactaatatgctgaggaatttgaactagaaaagctctcaagattctatttagtatatctaattacttattgaatatctctacttgtcttacaagcatcttaagttagtatatgcacaaactcaagatctttccccaccaaagttattccttctctggataatttcctatctcagagaatgaagccaccatcgacctagttgctcaaaacagaaactgagaagtcattctttctcgctgcttttctttatctgctaaaatcaagtgaattactaaatcatgttaagacaagttactgaatgtttaaaaattttattcatttctttccagataaattgtcactagtccagtccaggccataagcatttccccacctaaacaccgtaatggctttccaacttttccccacatccagtcttgttcctcctcaatgtaattttcacaatgcagaacaatattcttaaatgtaagcttgattatggcaacaaccttcttaatattcctcaatgacttcccatagaagaaaaatgttaaaactccttacattcagcttatagggtcctttgaataaggctctaaccttgaccctgcctaccttctcattcatcacttgacactctaaactttagccatactaaatttttgttcttcaaacttgccatgtctcacatctccaaaactttatgcattctgtacgctgccttccaacaccaacactcttgcttttcatccagctaacgcttcatcaatttagaagtcatttcttccagaagatttcctgacgctaccttcaacatgcatccttatcatggcatccaatgcttatcacagcatccaccccactattttaatccttgtttaactgtcatcatttttaaatttgacaaatattcattgagagcccattatattacagatactgtattctcctctgtatacagaatgtggtaaatatagagtattgtagaagcacgtttaggatgtgagagaagtccaagaaatgctttttagtgacttgtgttcccatctatttccctactaaattaaaccagagacagtttcataatcatttctgagttatttgaattgcctaacatagtatatagtagataaatattttataccatcaattattggattttaaatacatactaaatattctttgcattgtaagaggccaccagccagccaatactttctacccagcaactttttctttgatatcactttgcatacaatagagtgtaaaaagcaaagagacaaactaatatagtggaaaatatgggacttagagtcagaacactgtgattaataattctgccacttactaggtatatgtccttcgtcaagacccttaacctctctgagtctcaatttcctcatctgaaaaaggccattaggagaatgaaatgagataaagagaaaataaaagcataaaatgtaagaggttatccaaaatgatgtctattattattattgttattaaagtcaatgcagatcaagtctccttatgactggttatcccagctctgtaaggctacaagattttcaaagttcattcttcatcttccctttaccatccaagagataatcttttgtactttaataaacacatattgatggaaatggttaaaaatcacaaagaaaaacaagcccaaaattgaataagtatacattaatgtatgaaagggacaagacaaaagtaccagcctatgacagtttataatttgaatgtatggaccaaaaaaaaaaaaaaaaaaatcaggccacaattttttttaatgttgaccagaagggtaggtaggtggcacaaaagagtaatgctgtgaactgtttcacagtaaaatggtaacccattgacctagaaagtcaagatatctgggctcaaatactaatttagctactaattcaaccactaatacccaggtggtctacccacccaacactctagtctttcagttccttgatctccttagctcctattgtctttttctttcactgtatctcagccactcactcacagggccacaaatctcaaatggccactcaactttgcccagctgtgctattattctgattgctttccatcctccaaatgactattttgtatcttatcttctccccttaaacctcctacccaaatattcctcctcactctttactaatcttgcgtcataccttatcttcattgagaaaaagtatcagtatcaggccgaaggtctcacctctgaccactgaatctacccatctatctgcatctctacccatacttgctgtctttcttcttaccagaaattatacgttcatgtggttgggtgcggtggctcacacctgtaatcccagcactgtgggaggccgaggcaggtgaatcacctgaggtcaggagttcaagaccagcctggccatggtaaaaccctatctctaccaaaaatacaaaaaattagccaggcatggtgtgttggtgtgcgcctgtaatcccagctactcaggaagctgaggcaggagaatcgcttgaacccgggaggcagaggttgcagtgagctgagattgctccattgcactgtagcctggacaacaagagccaaactctgtctcaaaaaaaaaaaaaaaaaaaggaaagtatatgtttatatgttcatgttcctacctaaggccaatacttctatatattccctggattccataccctctcattttctcaaagacttcactcctaaaatatacacactctctcttataccatcatttccacccccctctattggattattctcagtctaaatatgcttaagtgtccttatctttaagaacccttctttgaccatacatatttctctattacctccatttcttggctctctttcatagtaaaacatcttgagatgtctatagtactacgtcaatttctgcccagccagcagtactatgtcaatttcttgacaccacattttctctttattgtactagtcaaggcatataactacttaatgtttccaaaacccaatgcacagatctctttattttatttgacttctaagcatgattcagtactgttggccatgttttgtagtcttggctttttttttttttttttttaattgagatggggtttctccatgttggtcaggctggtctggaactcccgtcctcaggtgatccacccaccttagcctcccaaagtactgggattacaggcatgagccaccatgcccggccagtctcggcttttatgtcactgcactcttcagattttcttcctacttcattggctattcttccatctcttttgttggcttcttttcctctgctttacactagtcactgcaatgttatcggtgagcacacttgccctaggtagttttccatatgctggtgactcccaactttgcatctttggttccttgcactctgcacagagctgaagcctcaaattacctttgatttctaataagaatgtaaaaattaaggtaagcaaaataaaactcccccctcccaccgccctggctgctcctttttcttccttagtcttttccatttggtaaatggcacaatcatccacacaagctcaagacaaaaatttaggggctagaggtgactcctttttcatcacctctatattcaaaacatcacaaaatctgtaggctctgcccccaaaatagagctcacatacatctacttctctgctattttatcccaaacttgtcattcctctttggatttctgcaattatcttctgctatagatcttgctccccacccagtatgattcagtcatcacataataggcagaacaaacctttttacaatgtaaatcagatcctatcactccctccaactcactactggtttctctttacactttaaataaattccaaacttattccatgggtagatttccatggcctattcaaagccttacatgatttggcccctacctatccctccaagctcatcctgtaccactttctctacattttagcttcagtggtcttgatgatgttcctggaaggagccaagttctttccttccttagggctcttgcaattggagttgcctttacctgtagtgcgctgatcccaaatatttccatggttggtttttaaaaatatcactaagcaatcaatctaaactaacccctcccccagtcttaaggaagacctttacagttttacttcttcactgtgcttactattatccaaaattccttgctcatatagtttacctattttctatcttacactcactagaatttaaacttcataagaacagcgatcttgctagtctttcttaccattgtattcacaatgcctaaaacaacgcctgacaaagtaggatattctttaaaaaatacttaatgaatgcctttccctaagcaagtcacttgacttctctacttaactcacactggtgagtttactactgctagactaagctctggatccaggaaaaacaaaagtggctaaggtatggcttcttcagaagctcatccattcattccctcaaaaaatatttattgaacatatattacactatgttccaggtactattcaatctcagtgtttagtaaacaccacagtaacatgggatttggttaaccaacagaagtgtttaaacaggatgagtacaaaaataagtacaaaatgagaagtactataaaaacgatactttatatgttacaactatagcacccacctatttccttgtgtctagtaattggcaggaccttatgacaagagccaactgaaaaacagcagtataaattctggtactctaaaagcccagacttcaccactgtgcaatatatccacacaacaaaactgaacttgtactaactaaatctgtatagaattttaaaaagtaagttaaaaaaaattctggtactcacaggggacaatacctatgaatgcccttttcataggcacacagtgactaaaatatttggggcatgaattctctaggggtgacaataataagtgtcatttttcatgcttctgttgcacacataattatatttatctctaaggaaaatcagagagtggggtgtggcctccctcagtgccacctgggccagttgtctccccacatcaccaaatctgttatttcacaggctctaggacacccatagagggggagtgagggacctggtatggtcccgtgaagagctcttgtaacactactgattgatgtgacagacacagtatgtgtgcaactttcctttttccttcaaaagcactggtctaaagcagggatccccaacccctgggcagcagacaggtacaggtttgtggcctattaggaacaggccacacagcaggtgagcagggctagaggattatgcctgagctccagctcctgtcagatgagcaaaggcattagattctcataggagcacagacctgattatgaactgcgcatgtgagggatctaaattgcgccttctcaagagaatctaatgcctgatgatctgagatagaagagtgtcatcccatcttgccccccaccccaaactgtcttccatgaaactgatccctggtgccaaaaaggttggggactgctggaagtgcttgtcccctgggttaaagccaagaggagtaaacaggattaaggggcgtggatgtgggtgggtgggggaagagagctttctcaggatcggcaaccaatcccagaatctccagtcgcaggagcatgtatgtgaaggtttatttgcagggatccaccgtttgtaaaatagtacacgcttaataaaattaattttgaggtcaatcttaactgacagatctcttctttcttactggcgagtatttgtaaaataagaaaaacaggaggaaaagagaacaaacaagagagatgtgggatgacggagtaaggaaaggagtcacggagaggagagacaatgtctgtggctgttccctcagcgtctgggagaagagcccaagaatcccattgaactgagggggaggaaaggccctcctgcggcctaccgcaaggaaacgatcgcggcagacccgggactagcgccaaagggcttggaagggcggcgttaagaaaaatgggccgtacctacaacttctttcgcagccctcgctggcccgggagcggcccaggagcccagtgaccgttgcgtaagccacgcgccacccaggtgggcagggtggtgacgcgaaagcccggatagacttccgcgcaggggcggggcggggc

SEQ ID NO: 2115 - DNA, 134705 bp, Homo sapiens
tctttggtagagctggctttattgtgttatttattcacagttttatggatccattaaaaaggaattaatgtaaaaagtaacaaagaataagctcaaggatgaaacgacatgctattttgaattcttttccaagagcactgcagattctgacacatctacatgtttagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacggtaagatgtctgtttacgtgtacactaaaattttgcagtgctaggattgtttcgcctcttaaatccccagttttgaagttctttaagatgagagaattttctgtaatatttggtattgaaagaccatattcctaaattgaagttttcatgtcatgatagatactacctacattagaaaagttggagcagcaaagaagaataaaaatctaatgccttcgcaatgtttggcatttatgtagagtaacatgtattttaaaatacacattctttgagagaggacctaaggtttaatggaaaaaagctttggtgtcatagtaaatagtggtcaaatatacttgtcacagtatgagtttggttggacaagttacttaatttttaatctctaatcttcagggtttgttttaacctgatacatccacattacatatctttgagaagtgagatgatatatgtaaactgctttaataatatgaggtagtaaatgatagcctcaattatagatgatttttaatgtgggaaggagtttggagtgataagtactataagtagttgacaaaatctgtttcttgtacttgatcatagattatttgaggtttttaatacagtattgctcatcacagcatcctttgtaatagcaaaatttttataaactaaatatctgataaaaagggaatgatcatgtttttaaaggatatataatgacatgagatcctgatatgagtaagaaagcatattacagtgtgatcccaattttgtttaaaaaacgaatacacgcaggccaggcgcggtggctcacgcctgtaatcccagcactttgggaggccgaggcaggtggatcaccaggtcaggggttcaagaacagcctgaccaacatggtgaaaccccgtctctactaaaaaatacaaaaaaaattagccaggcgtggtggcatgcacctgtagtcccagctactcaggaggctgaggcaggaaaatcacttgaacccaggaggcagaggttgcagtgagccaagatcacgccactgcactccagcctgggcgacaaggtgagactgtctcacaaaaaaaagaaaaaaaagaatacacacaataaatgcataggaaaaaatataccaaactgttaattattattacgtgtatctggatgggttatgagtgaattttttaaaatttatttttatttattctttatttatttttgcgggggacagagtcttgctctgtcactcaggctgaagtgtgatggcatgatctcagctcactgcaacctccacctcctgggttcaaggaattctcccacctcagcctcccaagtacccgagacacaggcgtatgccaccacgcccagctaacttttgtatttttagttagagatggcgttttaccatgttggccagactagtcttgaactcctgatgtcaagtgatttgtctacctctgcctctgaaagtgttgggattacaggcgtaaactaccgcaccagcctaaaatatatttttgttttcaaaaattgtgtggtatgcatgagttttatagcaagaaaaaattataatttattttgaattaaattccattgttttaaaattaagcaataggtgagctcgaattttaagctccacaaatgaccaagaacttattcgattcccttttaaacctgttgtctattttaatcactcatatggactcattcataggtttttatttaaaatctaaaccaaataatgaagtaactgtttaaattgttagattttgaatatggttcagttggatgtagaatgtaactattactcaggaaaacgatctgattttttttagcaagtgatatgctttctttctgagagcatttcacaaatgtttctacctaatgaatcatattttaaaaataacacttgtaattcttttttctttttagtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtattttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaaatttttgtgctttttaatcctactattatgaatctttttagtttcatcttacattactactctcataatagctatccttagccaggtgccatggcacaggcctgtagtcccaactgctgggaagattgaggtgggaggatggctgcagtacaagagcccaggagttcaaggccaggctgggcaacatagtgctccgcctctgctgggctctgtagggaatcctttctgttgtaaaagagttaccatttaactcccttcactgagtgcgtttctgagaccttgctaggcactctggaaactgcttagttgagaaaagacaaatacaaaagcttttctttagtctatttaagatacagtttattcagttcactttgctttctttttataagaatgtacaagaggcagacagaggtaatccttctagaaataaaactaattgttattgggcacttgtatgtaccagacactacactaagcatggtacttgggtttttaatttattacatgtaatgtcagtaggttcaattatatgatcgtaacatcttcatgaccagcagcatgtattttagagttagaaatgtagtctggtttttgagaagttttacaaggtgtatgtccaaaattgttctttcctcacatgtcagtgggggataaatacagcattgctctcacttctttgactctgggtgctttttcggatacattttcttcaacactgttaaggggcctcactgtcagattaaccaattatttttccacagttggtcaccagactttggaaaaaatccacctcaccaaaattttggatatcctgatctgtgttcatgaaatgctcttctttttgtaaaatctatcactgcatctcacagcaacttgttttcacacatgttctagtggttcccataacttagattttacaggaggcaaatttactaaaaatgaggagactaaaatgaatgaccaactttgaattttgtcaaataacattgaaaatgaattatctcataaaaggtaattttaataccccaaaagtaagatggttgtactctcagaataaagacttttccctgccacattttcagttgttaaaatatgctaagagctatgcccatatcttttcccacctgtgcacatttttcagaagcgtagggttggtagtaagctgttgctttaataactcctttaaataagcattattagcagtttgcattacttcttgtaaatttacacaattttatcttgtccatctttaaaaaatagacatctaataaccaaatgtatttgaattgatgcagtgtaagtaacttgtagaacttgaggataagtggtaaaagaaaaaaaaaagtaacttggctcttgaaatacatgtcttcggtttctagagccttcaaaatacagccctgttgttactgcgtcacattatgattgttttgaggactgcttctgcttacctaggaaactactcatgccttactcagcaaatgaacatcactattacataaacatcaggtatccaaaagtgttagcaggcttgaggtatgaatgattcattcatatgggtaattaagcaagttgaattatggaaagcacctcacaattcacacaattcagctttgagttcaatgccaaatacgatgattcattaagttgcctttgtattttgtaacctaatttgttaataagtaagttacaggaagccaattaagccagctgctgatctatatagtactaccttcctcattgtgattccatagtcttccaatagaaatgtgctgtcagaatctgtatagagagtttgtaaatgccactatttaacaaggttcttaagaatttaggtggatgttttatttgatacctaccaaagaagcctaagtaattgtataatacttaacccatttagaattcagttgtggcagcataaccaatctggagagaccaggggagatgttactaatgcttgtactttattcagaagtgagtgcctcattggcttggtgcagtgacgacacacctgtaatctcagcactttgggaggctgaggtgggtggagtacttgatctcaggagtaccataccagcttgggcaacgtggtgagatctcatctctacagaaaaatgcaaaaattagccgggcacagtggcgcaccagtagtcccagttactcgggaggctgaggcacaagaatctcttgagttgaggaggccaaggttgcagtgagccaagattgtgccactgcactccagcctgggcaacagaagtgaaaccctatcttaaaaaaaaaaaaaaaaaaaaaaaaagtcttttttttttttcatctaatcaaatttattgtggcagaaatcagtacgaagttcgtaggacaggaggaaaccaatataaatatctcagcattgtaggaaatttaacccatggaaagcaggggtgaattaaagaccactttgaaggctgggaaaagcagataatttagatatagtcaaagtatgaaatcattgatagatccagaacaaggaaatgatgtatgtgtttacatattacatctactttattaacaattttccctctgttaaactaatatcgactaatagtagtctaggtaagtcaagttcaaattaagtggtaattgaaaaagtcttctttttaaaaaatttttaatggtagaggcagcagctacccagagtctacttattcttacttcacattgaattctaacaagtttggttatctgatttctgcttcttaacaaatcacaagtatcaaaagggtcttgcagaaggggtgaactacagaatgtgacagctgacagcaagtcaggggaacaaaaataaatttaaggtgaacattaaaggcatagcagcttgagacaatttataggattctgcatacaactgtctctgaggacatcactgtgatcaaattatacaagtgatgtttagtgatgaattggaatcaagataagtagtatgtgttattcaaaaaggcaggatatgtgttgcatttggtggtaacaatttccccttagctatttagttaaaagcttagtgcttaacatgttggaaaatttatatgtaaaatatattgacttactcgatgattggaggctttatcacaggaagttttcccattcaattgaaacatttttcaagcttaatgactataatttactacataattatttattttgttaaagtttgaggaaaactaaataaagcagtagcaatttaagtcataataaattttgttagatgacttcttccactttagggggaattaaaaatcatgtttaaaaaccacatgtgcagcagttctgtgactccctcaacatccggttggccatatagtccctttgcaccacagaggttggagtatagaatatgcccaaagctgttttgttttgttttaactatgcttcatcatctgaggttgtgttaacatagtttgtcctaatagtcttttactggaaacttgctatatttgatcatgttcagcaagtaaactaattttatctactttcatatattttgagacaaagtctggccctgtcacccaggctggagtgcgggggcatgatcgtagctcactgcagcctcagcctcttgtgctcaagcgatcctcccacctcagcctcccaagtagctgagactacagtcatgcttcatcatgcccggctaattttttatttttctaagagacagagtctcactgtgttacccaggctggtctcgaagtcctggactcaagtgatcctccctgcctcagcactcccaaagtgctgggattgcaggcatgagcaaccatgcctggtgttttatcttttgcagaaatccaatttagtaaagtcatgttgtagcaagcatcactttaatataaaaagtgtacagcttatattattagcaattgtactgtttaattttatattagttatggtcttgaaggacattgaaaatctgttcagaaagactatgtttttcaaccagagatgacatcactctaactttcctttggtttaaatgcttgattcttcgcttacaaaacttctgttttgaacaactatggtgagaaagtatatttgtgatactgttttcttagaacactgttgtcagatagatcagccataatgttaacacatttctgatctctattataaggctgtaattttccaaaataatacagaaaaggagaaaagggtagtacatttcataattagagataaccctgtactagtgagaaaataaaaatgtcaagtttattaaattttcagatttcctgtaatttttccattactatccctcataaatttctctgcatgatcacactaaagatataaattaatcacatccattcaacaaattaagaaactcaaaactcacaagtacaatcttcaaccctatagaatgctaccaagaagtaaaataagatgaaggtagaaagattctctttgagggccaggtgcggtggctcacacctgtaattaattccagcactttgggaggccaaggcgggcagatcgcctaaggtcaggagttcaagaccagcctggccaacatcgtgaaaactcgtctctacaaaaatataaaaattagctgggcatgatggcggatgcctgtaatcccagctactcgggaggctgaggtggaagaatcgcttgaatccaggaggcagaggttgcagtgcgccaaggttgtgccattgcattccagcctgggccacagagcaagactccatctcaaaaaaaaaaaaaaaaaaaaaaaagaaaaagaaaaaagaaagattcactttgaaatgctgcatgcaactatttagcaacacattggaaaatctagagaaaatgggtaattttctggaaaaatataaatgaccaaaactaatccaagaagaaatttaaaatgttaatagaccagttacaaagaagagaatgtaaagtgattttttaaaatccataatttaaaaagtactagggttgcaagaaggataattccaatgttatttaaagtatcccaaattttttttaaaaagaaaaaccaattcatttcacataggcagtgcagcattaatatgaaaacctgataaacataagacaaaactgtaggccaggtgcagtggcttacacctgtaatcccagcactttgggaagccaaggtgggtggatcacttaaggtcaggagttcaagaccagcctggacaatatggcgaaaccccatctctactaaaaatacaaaaattagcctggcatggtggtgcatgcctgtaatcccagcttgaacccaggaggcagaggttgcagtgagccgagatcacgccactgcactccagcctgggtgacagagcaagtctccatctcaaaacaaaaaaacaaacaaaaaaaccaaaactatagaccaatctgacatacatatgaatgaatattctaaataaaaacccagcactgttatcaataattgcaacaacaaaaaagagtaatacagtatgcaaagagcactgtatttcaggaattcatgggtatttcaatatcagttaagtatattaacacaattacataaatgacatcaaagaagagaaaaatgtgattatatcaataaatgctgagagggctattgttaagattaaacatccactcctaatgaagattcttgagtaaaatagaaattgaaggaaagtgtctaaacataaccgttatttatgaaacgcctacaaaacaagtattttaaatcatgaaacaacgtttcaattaaaacaaggaaccagtaggaatagctgctgtcattatttgttattaaagattatcttggaggatccatgaatgtaacaagatttttaaatgaaataatcagtataaatatatagaaaactttttgtggatatgattatatgcctaggaaatcatagagattaggaaaaacagaaatttcaaatattttaaagaggaatattggtaagttatttggaaataagatgataatacaaaatatattagcaataagcaccttgaaatgctagtggtaaaaatattcacaataacaaaaataataaaggtaaaataaatttaccaagaaaggtagaagatctataagaaaaaaactataaaaatgttaccaaaagctactgaataagaaacacatgaggctaggcgcagtggctcatacctgtaatctcagcactttgggaggctgaggcaggaggactgcttgagcccaggagttcaaaaccagcttgggcaaattgtgaaacgctatctctaaccaaaacaaaaagctagttgggcttggcgcatgcttatagaaccaggtacttgggaggctgaggtgggaggttggggcttcagtgagctgagatcccaccactgcactccagcctgggtgacaaagtaagaccctgtctcaaaaaaacaaacaaaactcttgtaaaaacataaatctaaaattatatataaattcaattaaattcacattagaatcacaaaagcattttaaaattggattaaattatcttaaagttcatgtagaagaatagtcagaaaattgttccaaaaaaaagactattgagaggaacttttctcagcagatatcagcacctactatagaactattggaattgatcaattaagaaaaacaattgtattaagaataagcaagagtggtaaaaaattgagaatctacatgtagatgaaaaattaatatatgaaaataaacaattcaaagaaaacaaaattggaccctcaatttacactgaaggctttgaagtgacacataaaatgattttttaaatgatttaaatacgtacataaatggagacaggaagggtgggagagaagcagaagagaaagaaaatagaagactaaagaacaggaacacctatgtggaaaaaggtaacacttaatgacaaaatatgttttatgtgaatatcagttatacataataaatattggggacattgccttgtgggttataataaagcattaagaaacagagtagtgaacaaaaaaaggaaagaaaactaccaaattccatgtatgataccccattttaaaattacataaattaaatgtgtacacataagaaaattttaaacattaaaattttgttaataaaacagatttgataacacgaaggccaatgatgaccttacccacagcagttttgtttaaatggggactaaggatggagcaaaatttttagtagagcactttgaataatgaattagcaaactataataaactgaaatcttacctaccaaataatctcagtaaacaaatctaaaagaaatgagtaaaacaattgtgagcaaaaaaggatagagtcactacatataatgtaaatgagacaaggatggcctctgtgtattggtgcctaggttatttcttcacagcaagctgagacccattagctcaaaagccaactggcagcaaactcaaatttttaaacatccaattgtgttaaacattgcccagacatgcagatttgtaggcatttagagcctgcctgatttacatgccctgggaaactgtgtccaaaatctgcctgccacagataaaccctaggctgtaaagaccccaggctgcttctgctctttggaactctgtgaactatagactccatgccatgctgctgagtgatatcactgagacatgaaagcctcctctctgatcctttcctccctcaggagttcctttgccctcctccccttctgagtggtggcccccttgcctcaatcctctggtccatctcttgctgtgaaggccttccccaggatacaaacctgacgagatcatccagataaagcccatgtgtgcttctgtcacatctttttctatatttttctcacttttttctaaacttttctaattttttcttaatttttataaaattgtggatacctaataatgtagtctcaaaataaataaagccaaaattagaactggaaagagcaataaaaaaatccacaaacatagtgagagattttaacaattcatttttagtaattgaaaaaataaacactgcacaaacttcccgaggctccaccccgtaatcccagtgcacaggtgggcattattcagaatcagtggggaaagggcggcttcaaccaggacccgcagtccagtttatctaacagccttcaggctgttttagtcttgaaggtggggttttaccgggggacccttggttgcctcctgtctctatcactttcacattaggtgctttgtggtgaaaatggtttcaagggtgatggcattgtacatattgagacacagaagcagctgaaagttctattaaaaaatgaaatggatgcttctaaatgacagcaaagtctttgttggattaagtcttgtaaacaatgagaagcagaactcagagttaaaaagttcaccaatgtttacaggaagatttttggagaagacatggatggtaggtgccttaaagatctctttggcaagttgggatctgtcttaagtgtgaaagtagtggttaatgaaagtggaaaacccaaaggttttggatttgtcagctttgaaaggcataaagatgcgcagatgagatgaacagaaagaagctcaatggaaaacaaattgatgttggtcaagctcagaaagaagtagaatggcagatggaacttgtgtgcaaatttgaaaagatcaagcagtataggatcaccagataacaaagtgttaacatttatgcaaaaaatcttgatggtattgatgaatgtctctggaaagaactttctccacttggtacaatcactaatgcaaaggttatgaaggatggttgtcacaacaaagggtttgatttgtgtatgtttctcctctccagaggaagcaactaaagcactttcagaaatgaatggtagaattgtgggcactgagccattgtatatagcattaactccatgggaagaagagcaatgaagagcaccaggctcagctcattaaccagtacagtatgtgcaaagaatggcaagtgtaaaaactatgctcaacctgggaatcagcctctatcagccagcaccttcttcaatttacttcatggtagttatcccacagactgacagccatgctgcaaagtattctcctagccaaactgctcaactaagatcaaatcctccctaaattgctcagggtgccagacctcatccattgaaaaatatgcccaagccactcctagctcactacatttagtagtaagagaccagcttcttcacagcttccacgagtcatgtcaacacagctgttgtaacacatcaacacagacaataggagcacattctgcagttgccgctactgctactacagatactcctgctgtttgcaccatttcacagtataaatatgctatggaagttcacaatcctcaatggcagtttcatgcacagccccaagttaccgtgcagcagcctgctgttcatgtagaaggtcaagaacctttgacttccatgatggcatctgctcctcctcaaaagcaaaagcaaacgagtgaatggctctttcctcttcttcaagccatgccctagtcgtgctggtaaaatcattggcatgttgttggagattggttatttagaacttcttcatatgcttgaatctccagagcctcgctgtactaaggttgacaaaggtatagctgtaccacaagaccaccaagctaaagaggctgcccagaaagcagttaatggtgccactggtgttccaattatttaaaactgatcagggaccacagaaagaaacttgcgcatcactgaagaaaaaatctcaatatcaaaaaccttaaatactatggaaaaaatttgtaaagtataaaataaatttaaaaaggaaactttgaactttacataccaagcaaacgtcagatctaacaaatgcaatgatagtcctagattacttactgatttgaaaacaaaaaatcctcccaaaataataaaatataaaaatgctgcaatgcttttcagactctgtgataaataattttcagcaaagtataaaaatttaaagcattcctttaattttgtaattcgttagtgtggaatagctcagaatgtcacttctgttttaagtaacagaattgataactgagcaaggaaaggtaatttggattataaaattttgctttaataaaaattccttaaacagtgaaaaaaataggcaaagatacaaaaagttgataagaaacaacaatcttgtatttatttgttattttatttttttgagacggagtctcgctctgtcacccaggccggagtgcagtggcgtgatcttggctcactgcaacctttgcctcccaggttcaagtgattctcctgcctcagcctcccgagtagccgggactacaggcacctgccaccacgcctggctagttttttgtatttttattttttttgttatttgtatttttgtatttcaccatgttagccaggatggtctccctcccctgacctcatgatccacccgccttggcctcccaaagtgctgggatggtgtgagccactgtgcccagccttatttgtttaaatactataaacactaatatcatacacatggttaactggttgtaatttttaaattatattaataaatttttataaaaactttttataaataaaaaacttaaaatttcaaataaataacaacatctgccacaccaccttaaaagggcgactatttcagtataataaacatatatcacagacacttagagaaagttcaataaataaagaataaaaagaatagttacaacaattttcctcctaatcaataacacaattcctcattttgaaaattatttatctctcttttattaaaataaactttctactttgaaatctaatcctcttgtgaatgtaaaatactatcttgtaaatatatatatatatattttattattattattttttgagacagagtcttgctctgtctcccaggctggagtgcagtggtgcgatctcagctcactgcaacctctgcctcctgggttcaagcgattctcctgccttagccttctgagtagctgggattacaggtgtgcgccaccacacctgacaaatttttgtatttttagtagagacggggtttcaccatgttggtcaggttggtctcgaactcctgacctcgtgatctgcccatgtcggcctcccaaagtgctgggattacaggcatgagccacaacaccctgcttatatttttattttcttgtaagtgacaatgagatgccctcatgatttaaatagtagtcaaaacactggcacagtttaaatttttagaatttgagtactagaattacaatatttgaaaatggagtctgtactttgttgtaaaactataaggagaaaatgtcactaaaatagtagctattttatcttttcccagagttattctcccagagtgtattttctaagagttatttcccagaaggttttagaacttctggcagtttcggtgatatattctgtaaaagcccttagtcttaataggaataacacatagttttgattgccttaaattttaattgcttcacttggcaaatttatgtgtaaatgtcatattctgtggtattttaataccttgcttgtggagaagaggaaaaagaggaatgaaagtaatattcagtccttgcattgagcttttgccaaagaagtctaaacaatttctaagatgccattcaataaggccattttagaatcgtttatatgactcttataactttaaaataaagagtcttgaagttaattaaaactcactttgcttgtgatgggttctacattaacatggcagatttaatcagccagaattaaaaggtaattctatattactaaggagaagaaactgccacatgacagcagtctccaaatctttcatttttggaggctgccttttatgcctagattttaaaatactaattgaaaaaaatatagtttacttccatttgtgatttaattttatttctataaataaaaatatagatagtgtttcatctaaaaactgctaaaccagactttcattttaagggcatggcagaagtaaggaaagactaacttggttctattactgaacatattatttactcaggtagtcaccaaaaccagaatttaaaatctatttagttaacccatttaaagttgatgtgttttattccttttctttctttttgtggtgatctttttaactgaattactggacatcatgggagttctactccttctatttggaaacttaggctatcttaccaagttcaatattcaaagtttttctttctgccattaagtttgtttaattttatattaagctcagtttgtattatgatatcaaattcagcctgagggattactttaaactttcctagggtatttacagatttaatttgttcttacagtatgtaaataccaagagagcattccatttaatattatttttattaaattaactttggagtaaaaagtccaagaaaagccctgtactgaaatcacatgtttactaaatcctggattctctgtacagtccccacatatttctactttaaaattcttctgtcatgtgaaataattcattaaaagaagcaggcagatgatgacaggtaaactttttaatgatgttctaatgttgacaactgcagttttattttgcttggatcataatggcgtgtaagcattttaggccccagaatgcccataagtagagctccatttggagctgtgatcaagatggctaaaaatgctactgtcatcacatccttcgcatatggttccaagtggggtgcggagactcttgctgtttctagagccagaggacctaacacagcctgcatttaggggtaaaaatggggcataaagaaaaatattaaactgagttgatatataatgtaaatggctctgttaaaataaacaaaatctagtactagactattagaaaaaaaaagtactcagtaattttcataagttactcatcagttccatgttcttcctagcaaatatatgtggaggaagagtacaatagtgacaaatcagcaggcaaacatttttgggctgattttgcactcttgtcctctcagtgttcctctattcgaatatctcttttgagtgttcatgttgccctcataacaccaggagttctaacgaaaccagttttgcttagttgcctttaccgtgtgcaagtggttcttgactacaacaagacaacataaaatactaaggtttcttatggttctctaggatttgttgcccttcttctcattgttctccctattcagggggcactgtgttatagcagaactgacagcaggcttggaatctagcaaaccgggtttgaattctatttttgctgcaaccaggctagtgaccttgtacaaatgactcacactctctaaccttctacttacttatgtgtaaaatgaagaacaaaatacttatcttactgaatggttgtgaaaattaaatatgagaatgcaaagaacagctggcacacagtaggtattcagatagtagtaagtttctctctccctcactcctcatgccctgccaggtcagagaatgagttcctttgaagttttcgttttagaatgactgtactgggtcacaagtttttttccctagtcaccttctaccacattatttttaataacataaagcaaatttcttgctaaccctctttctttgtgtttaataatctaggcatgaaattgccttaaaattttggggaattaaataccaatatataacatattttctatggagttgcaaagtaacaacataatggtggaaacattacctctgatatggaacattatggcaaaagaacccctcaatttaagatcaatttctatatcctaaatcaataatttaaaatggtatcatttttatatcgtaacttttaatgtactgaacgtgagccagtgtgctggaggatgctagggagaaaaagataatcatgcagaaaaccaacttgaaagaatcttacagtttagaagaggatttgaacataaaagaacttccaacagaaaaaacaaaaaacaaaaaccaaacccattgacttttaagagatgattatgataatggtgaaactagaaataatatttatatagttatatggcattcatcatatggcaggtatcattcttaaagctttccatttatcaattcatttaattcttacgacaaccttattatgtgaggactttattagatgataaatgatttcctcctagtgactgagatttaatattatttctttaaaagaatccaattgccaagctgatcttacatttgtaaactaaattatttatttactctcctaatagcttcatttttccactctaatttttatcagtaactcgaaactgaagaacaagagaaagagctgaaccttagccaattttatgttagcagcagagaacggtggaagaggataaaggtgaaaataatttaaaattgaaatttaaatatttgttgatcttatttacttgtgacattatcgttatctattattgctgttgtgactctacttgtataaataattaattttttatgtcttgccagttcctggaaccagcttgatattctttgtgtagaagctagcctgaagccagcagacaggaataggcagaagcagaataatactgcaggactcgagtgagtggtctctttcctcatacctgcttttcttttttccctgctttatgaaaattatgaaataataaaacaaaattgcgagagtattgttggaaggagagagaacagatactccttttgtagatttattattccctacagtagacattaaaaataaaaagttattatttatattacttgaaggtaagataaaataacaacattgttaattgagcaccaccatatgccagagagagtgctaagcactttacgtggattatctcattgaatcctgacaacactgctaagaaacagatacagtcatagacttcattgtaagatgagaacactgaaggactgagagattagaaaataattttcctgaggttataggcaagtaacatggtattcaaaacaggtagtcaggccctatgaacctgcttttctaacatgataatagaggttttttttgcatgaaaatttaggagcttctgttttggaataacaactaagaaaagagccacaggaaattaaggtatattatgctgccaagttaaacagtctaacaataagtagcaatatattttaggaggaggagaatatccttgaataagagggcaaaattacaaggtttccctttctgttcattcattcttgcaggcatgcaatacacatttggctcctgcatgtcaggcactgtgttaagtgccagggagaaataatgaaaaacaactgcaacaaccagacactgtccctgtccttacgtagtctatcaagggggcaggggcagggatttagccattaaccaaatagaatacaaataaatgtgtaattaaaaacaataaatgtgcatttgtgtgatggagtgagtggcaaggtaggaaaagtattttttaaaaaatcaatgtgtctctattttactttactttttttttttttggagacagggtctcattttgtcacccaagctggagtgaagtggtgtgacctcagctcattgcagcctcaacctcctgagttcaagcaatcctcctgcctcagcccccaagtagctgtgactacaagtgcgtgccaacacacctgactaatttttttgtattttttgtagagacgaggttttaccatgttgctcaggctggtcttgaactcctgagctcaagtgatctgcctgcctcagcctcccgaagtgctaggattccaggcatgagctaccatgcctggcctgtgtctctactttttaaaatcataacatttagctttgttatattcagcaaaatataaaaactccaattttcagatatattcttattatatattttaggaaaataaaaaacattttcataaacttaggaagtacttattgaaagaatactttttaatttcaaaagaattgcttttaaaactgagatttaaaaaggttacattggctgggcccagtgggttatgctcataatcccagaactttaggaggctgaggcaggaagatcacttgaacctaagagttcaagaccagcctgggcaacatagcaagacctcttctctacaaaaaaatcagaaaaaaaagaccaggcgcagtggctcatgcctgtgatcccagcactttgggaggctgaggcgggtggatcacttgaggtcaggagtttgagactagcctggccaacgtggtgagaccccatctctactaaaaatacaaaaattagctgggtgtggtagtgtgcacctgtataatcccagctactcagaaggctgaggcaggagaatcgcttgaacctgggaggtggaggttgcagtgagccgagatcatgccactgcactccagcctgggcaacagagtgagactctgtctcaaaaaaaaaaacaataaaaaagcagttgggtgtggtggcaggtgcctgtgatcctagctactcaggaggctgatgtgagagaattgtttgcgcccaggaggttgaggctgcagtgagctgtgatcatgcgactgcactccagtctgggtgacagagtgagacctggtctcaaaatgaaaataaaaataaaaatagaaaaagattacattaaggttctttgtttttgtttatttatttatttatttatttatttttttgagatggagtcactctgtcgcccagactggaatacagtggtgccatctcagcttactgcaacctccgcctcctgggttcaagcgattctcccatctcagcctcctgagtagccaggactggttacgttaattttaatgaatagttatgatcaatcaaacatttaaaaagtaaggataatagctcatattttgtgactagagtaacatttttcattttaaattttaaaagcatcaaaatgaaagcattaagcaacaggcttaatatgttcttacctgtactgtagctttgggcatccatgctaaagcaataaatattttctccttaaaactaaaaccagcaaagcacatcaatagatatgtggttaaaattcgaacacataatgccaaacttagagtggcaacagatatgcctacaacagatgaaaacaaacataaataacaaaatatttgtgaagaagtgttcttcatgcccaggaatatgatttctaaaacttttgaaaacattttaaggctattgtctcttcatgtgcttattttttacataaaaacaatgattataaaaaatgaatatgatggaggattctctgtaaagtgcaagagagtatctgatggtggaagtaccatgaaaaataagacagatgacatttatacaattctgaactaatagacttcttttgaatacttttattattaataataataatttattttttgagaaggattcttgctctgtcacccaggctggagtgcagtggtacaatctcaactcactgcaacttccgactcccgggttcacgcgattctcctgcctcagcctcccgagtagctgggattacagacgcgcactaccacacctggctaatttttgtatttttaggagagagggggttccccatgttagccaggcaggtctcgaactcctaacttcaagaaatctgcccgcttcggcctcccaaagtaagattacagacatgagccaccacgcccagccaatagttttaaatgaaagtactcaaaaagcgctgatcgtatcaaatatgttccctcaggaaagaaatcttatatttatttcttcagataactcagggaatatattcagggctgtccttggtttataaaaaaaaaagagcacccagtgtaaaggaagagcaatatgaaaatatgacactgtatcaacatgtgtttctgaagaaggtcgttgtagccaaagatatattgtaaataaaaataaatgtatttataattttcttaaatatttttgaatttcatattttttgtgctctaattattcttaccaacaatatttgattcaagcgatgaaacagatacttctgctccaactaaaccaaaaagaagtggttgaaaaatatcccatacagtcgtaataatcttttggactttcatctatagaaaagagaaatacatttataatgattttggcacataaatatatttcagaaacttaaagtcttccccccccttttttttttcattttttaagtattttagagatggggtcttgctctgttgcccaggctggagtgtagtggcataatcatagctcactgtagccttgaactcctgggctcaagtgatcctctcgcagtctcccaagtagaactacaggtgtgtaccaccatgctgggctaatttttaaattgtttatagagatggagtcttgctatgttgcccaggatggtctagaactcctgtcctcaagtggtctctggctgtggcgtcccaaagcactggcattataggcatgagccaccatgcctggcctaaagtcatttaacatttaataaatttaagacactttattttaataaaaatgttaaacttaataaaaactgagcacttcaatagttttattcaaacacttaggtagaatttgattaaaataaactcacaaagcaataaaataatactatttggccattttgtcacagaataagtgatgtccttagggttctagccatgtttcgtatgagttccagattttgtctgtaaagtaactgaacagagatataactacatcatgcctgatgagaacatacccagttcatgcaaacatttgggttctcaaaagggggttgggaagccctccactaacaaccatcctggaactcaatcccattaaagtgaatcctgatatatatagcatatactactaggaaaaacaatttggaagtctgctaggcctgcttccaaagaacccatgttgaatattttaaagttactttttccttaaaacaaaaccaaaacatatattagattctcatttaactgcctacccagcttccctttctggaaacgaatgcctcccagtgctacttccccaattaaaacgttacaggaaaggcccctattggcctacattactctggctcttctccaggaatttggatgaagagatttcagtctcagtctgggtttaacatttttttttttaaacagaagatacataagaactttgatgtctcttccttgaggcataaactatcttcataactatttcccttatgactgtgttttctgatccccacttattatagtttaaaaaaagaaaaacaaagaaaaacaatgttactattctttacagcataattatcctatttgttacttttaatctttaaaacttgttttagttctgtttcttttaccatttaaaaaaattctagcagttttaattttatttattgatttgcatttcattcatttcatttcttttatcattatgattatataagaatactaaacaaaatgtcactatgatttttggttggggaacttctcaagctgattctaaaatttatctaagaaagaatatgtgtaggaacagccaaaaaatactttaaaaagaagtataatctatattagattttgacacataaaactgcagtgatttaaaacagtggtgttggcatagaaatagagaagtaggattaaatagacttcagaattaatatatatgggagaatttagttcatgttaaaaaactgaattattaatgaattggtcaataaataaacaatttggcaaaaaatgactgtctagtttatgtgcatatatctgtatgtacatattcatcacatgcaagtacatatgtgtgtctgaatatatatgtatatttatgtgtgtgtgtatagatatatatatatacatacacacacatcaggcatgatgtagttctatctctgttcagttaacttacaaactgtatgtgtgtgtgtatatatataaatagtttgtaagatacacatatgtatatatgtataaccttacctcacagcattcacaaagataaattccagatagattaaaagactaaatgaaaaaaacaaattaaacaaacaaaaactaccaaaatattaaatgataatatacaaaatagtatatctttgtaacgtttatatgttataatcttcagtgagaaagtccttcttaaatgagatgcagaatccaaaaccaaaaaaggaaaacccaataggtttggtcataggaaattttactttcatacaccagacaccataaacaaagttgaagataagcaaaaattatatgcaatatatacataacaaaggatcagtagccctaagagaaactataaattagaaacaaaaaaataaataacccaataaaaatggtcaaagaagatcataggtattttaaaaagaatatatgaagagaagcttactatactactaatcagagaaatgtaaataaagaataacaacatcacataattgtaagaaactacaagaattggatggtgaggtcatctaatagtaaaaagaatagaactagtgataatatcaagtgctgttgatgagttaaggaattagatatttttgtgcactgttggcagagtgtaaataaccaaaatcttttgaagggataatttagcagtgtccatcaaaataaaacacagatcatttccagctaggtgtggtagctcatgcttgtaatcctagcactttgcgatgtcaagttgggaggatcccttcagctcaggattttaagaccagcctgggcaacatagagagactctgtctcaaaaaaaaaaaaagtcatttctaggactctatccctatagatgtacctgcaatcccaacattttgggaggccgaggcaggagtatcacctgaggtcaggagtttaagacctgcctggccaacatggtgaaaccccgtctctactaaaaatacaaaaatttgctgggtgtggtggtgtgcgcctgtaatcccagctactagggaggctgaaacagaagaatcacttgaatccaggaggtggagtttgcagtgagccaagattatgctactgcactccagcctgggtgacaagagtgaaactgtgtctcaaaaaaaaagacatgaacaacactgtttatgacagcactgtttgtaaataacaaaaagtggaaacgatcttaatgtctataaatagaatactggttacttaaaaaaatgtaagggggtttgatatttgacagtggtggggaataaagaaatcttttacattttattctatatgttttattcttttacaagcatttctatttttattatttgtttgtttattatttatttatttttttgtgatggagttttgcacttgttgcccaggctggagtgcaatggcatgatcttggctcctgggttcaagtgatgctcctgcctcagcctcctgagtagctgggattacaggtgcccaccaccacaccaccatgcccagctaatttttgtatttttagtagagatggggtttcaccatgttggccacactggtctcaaactcctgaccccacgcgatctgtccgcctccacctcccaaagttctgggattacaggcatgagccaccgtccccggccttttacaaacatttttcatggattaattgtataattaaaatttcaatgaataaaataattagattgataaaggtaatataataatattatataaaacttgggaaaaagagaagcctgatgtgattaactcaacttctgattccatattagtatatttccaggtgcttttcctaaatattttctttcctcgattgattcatacactttcttgaggacagaaaaccttttggaacattttccaaccagaatgaggggatttcctaaatatatgtaaaaaattcagttgttttagcttttaaaatatagcatattaaaaatattcaccttttcttgggaccattttgtccctgcaatgaaactcaacactagtgtgcataatcctccagatccatgtaaaccaatacgttggctgcctaagacggcagaaacacacatagtcaaaacaaggaatcctctcttcaatgtaagttttttctagaattagatagatatttagaaattagtttatattaaatatataatataagatttgacattatctattatatatttttgaccctctgatattatgtctttaaatgttatattaaatgtctaaaattttgattttctttctcaccatatattttagcagacttactaccaagtaacaaaatttgcaattagtcacgtttcatcttctgccatatctctgatactagtatcagtaatatggttaaagtattactataagtgaagaagaaaagagacccataaaatctccagtttcatataacatatccaatgaattcttaaaaaatatttgaatatctctttggtcaatatgttacagctaaatttggatggaaattacagaaatacaaaagtaatggcatgttttcctttaaggcaggaaatggctaaatttgagtgttgcctttgtcaaaggagagcaggagtgaatttcagtcagaaaatatgcagaaataaatggggacctatttccccctaaaatgtttaagggaaaatttgggggaaattatcaaacatcagtaggcagtttagtagagaaagggaaagtataattcagagggatactctgcattaagtatattttttgatattccttatttgccaaattaagaagcagagactttaatcaaagccattgacctgtatcaatcactgctgtgctcagttttaagtacagagtaggcattggaggctagttttagagaaatagaattaagtattaaatttcatcgaccttaccaaagtttaatattttgaaaaaaatgtctaatactatacttctataaaatagattttgtatttacctggtcttcacttggaaaatatcgaacaaaaaatcccaaaacaattcctgccagcagactaatacatacgttccttatagaggctatggcgttattaagtataccacctgtaggggcacacaataaaaaaaaattcacaaagaagtatcttcacatacactacacatcagaaaagcaaatctaggtggttcatgaagaaaagtaagcattttatagaacaaatatatgcaaatggtctttttatagtgacatatatgaaaacatgtagatctatttagtacgttaaatatatactctcaaataatttaatatatacacacaactcagaaatgtccattatgtaaataggccagaaaacaaagacttaacaagcacaagatgctccccttacatagccaacttaaaagacagagtgaggtagtccaggcacagtggctcacgcctgtaatcccagtgctttgggaggctgaggagggtggattacttgaggtcaggagttcaagaccagcctggccaacataatgaaaccccatctctactaaaaatacaaaaattagctgggcatggtggcacacacctgtggtcccaggtactcgggaggctgagggaggagaatcacttgaacccgggaggcagagtttgcagtgagctgagatcgtgacaccacactccagcctgggtgaaagacggaggccacacctccaaaagaaaaaaaaaaaaagactaagtgaggtacaagaatggagagagaccgaaacacttgtggcacttagcatatggctgttaagggctatattaacaattcttctttcatgtactatatgaaaaagaaacaaatgattttaacatgaaaagaacaatgtaataacaacataaaaaattttgttccagggtcagtcctagaaacattcaagggtcaattaagatttcagtatatttaagtatctgcttttggtgaagaaaaaaggaaaaaaaatacaaaagattccagtatattttatattcattaatattaatatatccatacttgtagttcattgtaataagtaaaaaacaaaaaataaaaaaacaaaatgagtcacaaaaatagttcagttaagctctgggtagtggattcaatatagtaagtaagtatatttttagacatattttctactaaatataacaggcagggcatggtgggctcacacctttaatcctagcactttgggaggccaaggcagaaggattgcttgagcccaagagtttgagaccagcttgggcaacagagtgaaaccccatctttacaagaaaataaaaaactagcccggtatgtggtgtgtgcctatagtccaagtactcagtaggctgagggaggaggtcccttgagctcaggagtttgaggctgcactccagcctggctgacagagcaagatcctgtctcaagaaaataaaatacaataaaaataaaaaataatataaacagagagatgtcagccagatggtggaatggggagctccaaaccttgattctccataaagataccaactgaacaacaatatatggtctaaaagcctttatggagttccataaaccattaagaagctgtagtagcacagacaagtgcaaagccaagaatagtggcattgaacaaataagaaaagctgttgcattatactcatgataccccttccccaagctggaacaggttggtgtggctgggaagcactcaacttgcagcttctccattagcagggaaagagaagactggaacggaatagttttatgaggttacctgaagctctctctctctctctaacttgacacccaactggcatactttggatgcgtgggagccactgggaataaaggagaggtcagagatgatgcagcaccagggaacctgcagtgccacagacagataccagagagaacaacagctccagaaaaagaaactggcaaacctctacttgggatgttgcaatgtataaacccaaagaagatgcattcccagaaaaggtttgagaggctgctagaacctatagccatgctgattcaggtaaaggtcttccgtatgaagccagctgataaaaactgggagcagtggcagttttttcaaacgtccaaatcttggcaaaaataagtaaaaaataaaaaaataaaaaataacaggcataagaagaaacagagaaacctgatgactaaattaaaggagcaaaataaatctccagaaaccaatcctaaagaaatagataaatgagttacctgacaaagaatccaaattaactctcttaatgaagcccagtgacaacagaaatagataactaaatgaaagcaggaaataattcatgaacaaaatgaaaatattaacaaagagatagaaactaaaaaaaaaaaaaaaaaaaaaggaaccatacagaaactctgaagctaaggaatacaacagctcaattgaaaaattcactattggaaatcaccaacagactgtgtaactgcccaatgggttcaccttgtgccctgcttagacagagctgatttatcaagacaggggaattgcaatggagaaagagtaattcatccagagccagctgtgcgggagaccagagttttattattactaaaatcagtctccctgagcattcggggatcagaagttttaaagataatttggcaggtaggggcttgggaagtggggactgctgattcatcaggttggagatgaaatcatagggggttgaagtgatgttttcttgctgtcttctgtttgtgggtgggatggcagaactagttgagccattattaccagtctgggtgcactggatgaatcagccagtgcagggtctgcaaaatatctcaagcaatgattttaggttttacaatagtgatgttatccccaggagcaatttggagaggttcagactcttggagccagaggctgcataacccttcaactgtaatttctaatgctatagctaatttgtttatcctgcaaaggcagactggttccaggcaagaaggggatcttttcaggaaatggctattatcaactttgtttcagagtcaaaccatgaactgaataccttcccaaaattagttcatccgactgccaggaatgaacaaggacagtttaaatgctagaagcaagatggagttgattaggtctgatgtctttcactgtcataatttcttcagttgtaatttttgcaaaggcagtttcaataacatcaagcagaataaagaatcagtgaaacagaagactagtcatttgaaattatggagtcagaggagcaaaagggaaaaggaatgaagagtgaagacagcctaagagacttataggatgccatcaagcagaccaatgtatgtattatgaaagtgccagaagaagagaaaaataaaggggcagagagccagttaaaaaaatgaccaaaaacttctcaaatttaaagaaggaaatggacatacaaatccaagagtctcaaagaactccaagttggataatttgcaaaagacctacaatgagacacattacaatcaaactgtcaaaagtcaaagacaaagagagaattttgaaaggaacaggatcaaagcaacttttcacatacaagggagatgccatatggttatcagtggaattctcagcaaaaactctacaggccagaagagaatgggatgatatattaaaagggctgaaagaaaaaaaaaaaactgtcaaccaagaactgtatagccagtaaaactgtacttcaaaaatgaaggacaaacaaagagttccccagagaattaaaaggtgagggaattgatcaccactagacctaccttacaaaaaatgttaaagggagtcctccatgtggaaatgaaagggcattggatagaaatacaaaagcatacaaaacataaacttctttggtaaaggtaaatatatgagtgaacatagaatcctttaatactgtaatggtggtaagtaaaacactttttttctttacttttttctttttcttttttgagacaaagtcttgctctgttgcccaggctggagtgcagtggtttgatcacagctcactgcagccttgcaggcctgggctaaagcaatcctcccacctcaacctcccaagtggctgggactacagacatgcaccaccacactcagataatatttttaaatttttagcagagataaggtcttgctggtctcaaactcctaggctcaagtggtcctcccattttggcctctcaaagtgctgggactacaggtgtaagacaccacacccagcctgtaattcacttttaattgaagcatagaatttaaaaagtaaaagcataacattactgtattaaattatgtgaataaacaatataaaaatatatattgtgtgacactgataacaaagtgagaaggaagtgtaaagaagtagagtttttgtatgtgattaaagttaagttgttgtcaatttaaaatagattattataactatgagatgttttcatgtaattctacagtaaccacaaagaaaagacctacagaagatacacaaataaacatgagaaaggaacccaagcatgcccctaccaaaaaaagaaatcagtgaaacataaagggaggcaggaagagaggaaaagtggaaaaaaatagctgcaagacatacataaaacaataaacaaaatgacaatagtaagcccctccctatcagtaactactttaaatgcaaataggctaattttccaatcaaaagacagagattggccaaatggatttaaaaaaatctaaatatatactatatgcaagagacttacattagatctaaagacacacaaaggttgaaagtgaaaggatggaaaaagatattcaatgcagttggtaaccaaaagagaacaacgatggccatacttagacaaaatagagtttaagtcaaataatagcacaagagacaaggatattacataataataaaagggccaattgaccaagaagatatagcaattataaatatatatgcaactaacagtacagcatctaaatatatgaagccaacatagacagaattgaggggtaacatagataacaacatcataataacagaaaacttcaatatcccactttcaattatggatacaataaccagacagaagatcaactggaaaacagagaacttgaacaacactgtagaccaattggacctatctgacatatacagaacacttcacccaataatagcaaaatacactttcttctcaagtacataccaagacttttccaggataaatggcatgctagtccacaaacaagtttttaaaaatttaagaaaactgaactcataccaagtatcttttctgaccacattaaatgaaattagaaattcatagcagaaggaaaaaggaaaagtaataaatatgtggaaattacaaaaatatactctgttaaccaattggcctgtatggttaatattaattgtcaatttgattgagggatgcttagatgcctgatgaagcactgagtgagggtatatctgtgagggtgctgccacaggagaatgatggatgagttagtggactgagagagaaagacccatcctcactgtgggtaggcatcatgcaattggttgcaagtgtggctagaacaaaaaggcagaagaatgggaacattcagcttgcttggatttcttttttatgcactttctctctcttccagagcagtatgcctttttctcctcttgcccttgcacatcaaactctaggttcttttgcctttggaccctggaacttgcatcagcagccttttgggagctctcaggcctttggcctcagactagtggctgcactgtcagcttccctggttttgagactttcaaatttggactgagccatgtcactggcttccttgggagccatgctttaggcttctctcattttccggcttatagatggcctattgtgggactttgcctttgtaattatgtgagccaattctccttaataaattatatttcatatatatgtaaatatattctcttttatatgcatgtatctatatctatatctatatctatatctatatctatatctatatctatatctatatctatatctcctattggttctgaccctctggagaactctgattaatacatagtcaaagaataagtcacaaggaaaattagaaaatgtctcgagacaaataaaaatggaaacacaacattccaaagcttgtgggatgcagcaaaatgaatatgaagaggacagtttatatatctaactacctaccttaaaaaagaagaaagatctaaaataagcaacttagctttacacctcaagaaactggaaaaagaagaactcaatccaatgttagcaaaaggaaggaaataataaagtctagagcagaaggccgggtgcaatggctcacgactgtaatcccagcactttgggaggccgaggcaggcagatcacctgagatcaggagtttgagaccagcctgagcaacatggagaaacctgtcactactaaaaaatacaaaattagccaggcatggtggtgcatgcctgtaatcccagctactctggaggctgaggcaggagagtcacttgaaccgggaggcagaggctgcactgagctgagatcgtgccactgcactccagcctgggcaataagagcaaaactccatctcaaaaaaaaaaaaaaaaaaaaggctagagaaaaaaaaaacccaatgaaactagtagttgtttcaaagttcaacaaaattgacaaataatcagctagaatatttaagaaaaaaaataaagaagactcaacttcttttaggaacaaaagagaagacattgcaacagatattacagaaataaaaaggattctaagagtctactatgaatgattatatactgacaagttggataacctaggagaaatgaacagattcctagtaacatgcaagttaccaagactaagtcacaaaataaaaaatcttaatagacctataactagtaactgaatcaggaatcaaaaacctcccagcaaaccaaatacctgataaggggttaatatctaaaatatatacagaacaacaactcaataacaaaacaacataatgagaaacggtcagttgactttgctatggtccaaatgtttatgttctcccaatattcatatgctggagcctaatattcaatgtgataatattaagaggtggggcattttggagatgattagttcatgaagtcatagccctcagaaatgggactagggcctttataaaagaggcttaagggagtttactttcccttttgaacatgtgaggacaaagagaaggtgctatctatagtgaatatagtgacctcaccagtcactgagtctgttgtagcctaaatcttggacttctcacattccagaacgcaagaaataaatttctgttgttcataaattaccagcctaaggtattttgttatagcagcaggaatggactaagatagacttgaacagacattttttccaaaaaaaaatacaaatggccaactagcatatcaacccgacactatgtggcagctgccaaggcttggggattgaactctctgaagcaatagcctgagctgtatgttggctccttttagccatggctgggacatagtgcagtcccaagactgcacagagcagcaaagctctgggcctggcccacaaaaccattttttccctcctaggcctccaaccctgtgacgggaggggctgttgtgaagaactctgacataccctggagacaatttccccattatcttggcaattaacattcggctccttgttacttctgcaaatttctgcagtcagcttgaatttctccccagaaaatgggcttttcttttctatcacatcataaggctgcaaatcttccaaacttttatgctctgtctcccttttaaacataagttccaattccaaaccatatttttgtgaatgcataaaactgaacacttttaagagcactcaggtcataaactgaacactctgctgcttagaaatttcttctaccagatgtcctgggtgggttccaagatggccaaataggaacagttccggtctgcagctcccagcatgatcgacgcagaagacaggtgatttctgcacttccaactgaggtacctggttcatctcattgggactggttggagagtgggtgcaggcccacagagggtgagctgaagcagggtggggcatcacctcacccgggaagcacaaggggttgggggatttccctttcctagccaagggaagccgtgacagactacctggaaaaacagggcactcctgcccaaatactgcacttttcccaaggtcttagcaactagcagacaagatgattctctcccgtgcctggctcagcgggtcccacacccatggagccttgctcactactagcgcaacagtctgagatccatctgcgaggtggcagcctggctgggggagggccgtccaccattgctgaggcttaagtaggtaaacaaagcggctgggaagcttgaactgggtggagcccactgcagctcaacaaggcctattgcctctagactccacctctgtgggcagggatagctgaacaaaaggcagcaacttctgcaaacttaaacgtccctgtctgacagctctgaagagagcagtggttttcccagcatggcgtttgagttctgagaatggacagactgcctcatcaagtgggtccctgacccctgtgtagcctaactgggacacacctgccagtaggggctgacagacacctcatttaggcggatgcccctcttggacgaagcttccagaggaaggatcgggcagcaatatttgctgttctgcagcctccactggtgatactcaggcaaacagggtctggagtggaactccagcaaactccaacagacttgcagctgagggtcctgactgttagaaggaaaactaacaaacagaaaggaatagcatcaacattaaccaaaagatcatctacaccaaaaccccatctgtaggtcaacaatgtcaaagaacaaaggtagataaaaccaaaaggatagggataaaccagagcagaaaagctgaaaattctaaaaatcagagcacctcttctcctccaaaggatcgcagctccttgtcagcaatggaacaaagctggatggagaatgactttgacgagttgacagaagtaggcttcagaaggttggtaataacaaacttctccgagctaaaggaggatgttggaacccatcgcaaggaaggtaaaaaccttgaaaaaagattagatgaatggcttacaagaataaacagtgtagagaagaccttaagtgacctgatggagctgaaaaccttggcacgagaactttgtgacacatgcacaagcttcaatagccgattcaatcaagtggaagaaagggtatcagtgattgaagatcaaataaatgaaataaagtgagaagacaaggttagagaaacaagagtaaaaagaaatgaagaaagcctccaagaaatatgggactatgtgaaaagaccaaatctacatttgattggtgtacctgaaagtgatgaggagaatggaaccaagttggaaaacactcttcaggatattatccaggagaacttccccaacctagcaaggcaggccaacattcaaattcaggaaatacagagaacaccacaaaaatactccttgagaagagcaattccaagaaacatacttatcagattcaccaaggttgaaatgaaggaaaaagtgttaagggcacccagagagaaaggtcaggttagccagaaagggaagcccatcagactaacagtggatctctcagcagaaaccctgcaagccagaagtaagtaggggccaatattcaacactcttaaagaaaagaattttcaactcagaatttcatatccagccaaactaagcttcataagtgaaggagaaataaaatcctttacagacaagcaaatgctgagagattttgtcaccaccaggcctgccttacaagagctcctgaaggaagcactaaacatggaaagaaacacccggtaccagccagggcaaaaacaggccaaactgtaaagaccatcaatgctaggaagaaactgcatcaattaacgggcaaataaccagcaactatcataataacaggatcaaattcacacataacaatattaaccataaacgtaaatgggctaaatgccccaattaaaagacacagactggcaaactggataaagagtcaagacccatcagtgtgctgtattcaggagacccatctaacgtgcagagacacacataggctcaaaataaagggatggaggaagatctaccaaacaaatggaaagcaaaaaatagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaagagcacccagattcataaagcaggtccttagagacttacaaagagacttagactcccacacaataataatgggagaatttcacaccccactgtcaatattagaaagatcaagaagacagaaggttaacaaagatatccaggacctgaactcagctctgcaacaaacagacctaatagatatctacagaactctccaccccaaatcaacagagtatacattcttctcagcaccacatcacacttattctaaaattgaccacataattggaagtaaagcactagtcagcaaatgtaaaagaacagaaatcacaacaaactgtctctcagaccacagtgcaatcaaattagaacttaggattaagaagctccctcaaaactgaacaactacatggaactgaacaatttgctcctgaatgactactgggtaaataacaaaatgaaggcagaaataaagatgttctttgaaaccaatgagaacaaaggcacaatgtaccagaatctctgggacacatttaaagcagtgtgtagagggaaatttatagcactaaatgcccagaagagaaagcaggaaagatctaaaattgacaccttaacatcacaattaaaagaactagagaagcaagagcaaacacattcaaaagccagcagaaggcaaaaaataagatcagagcagagctgaaggagatacagacacaaaaaacccttcaaaaagtcaatgaatccaggagctggttttttgaaaagatcaacaaaattgacagactgctagcaagcctaataaagaagaaaagagagaggaatcaaatagatgcaataaaaatgataaaggggatatcaccactgagcccatggaaatacaaactaccatcagagaatactataaacacctctatgcaaataaactacaacatctagaagaaatggataaattctgggacacatacacccttccaagactaaaccaggaagaagttgaatctctgaatagaccaataacaggctctgaaattgaggcaataattaatagcctaccaaccaaaaaaaaagtccaggaccagatggattcacagctgaattctaccagaggcacaaagaggagctggtaccattctttctgaaactattccaatcaatagaaaaagagagaatcctccctaattcattttatgaggccaacatcatcctgataccaaagcctggcagggacacaacaacaacaaaaaagggaattttagaccaatatccctatgaacattgatacaaaaatcctcaataagatactgacaaactgaatccagcagcacatcaaaaagcttatccaccacgatcaagttggcttcatccctgggatgcaaggctggttcaacatacacaaatcaataaatgtaatccatcatataagcagaaccaaagacaaaaaccacatgattatcttaatagatgcagaaaaggcctttgacaaaattcaacagcccttcatgctaagaactctcaataaactaggtattgatgggacgtatcttaaaataataagagctatttatgacaaacccacagccaatatcatactgaatggacaataactggaagcattccctttgaaaactggcacaatacaaggatgctctctctcatcactcctattcaacatagtcttggaagttctggccagggcaatcagggaagagaatgaaataaagggtattcaattaggaaaagaggaagtcaaattgtccctgtttgcagatgacattattgtatatttagaaaaccccatcatctcagcccaaaatctccttaagctaagcaacttcagcaaagtctcaggatacaaaatcaacgtgtaaaaatcacaagcattcttatacaccaataacaaacagagagccaaatcatgagtgaactcccattcacaattgcttcaaagagaataaaatacctaggaatccaacttacaagggaaatgaaggacctcttcaaggagaactacaaaccacttctcaacgaaataaaagaggacacaaacaaatggaagaacattccatgctcatggataggaagaatcaatattgtgaaaatggccatattgccaaaggtaatttatagattcaatgccatccccatcaagctaccaatgactttcttcacagaattggaaaaaactactttcaagttcatatggaaccaaaaaagaacctgcattgccaagacagtcttaagccaaaagaacaaagctggaggcatcacactacctgacttcaaactacactacaaggctacagtaaccaaaacagcatggtactggtgccaaagcagagatatagaccaatggaacagaatagagccctcagaaataatacgacacatctacaaccatctgatctttgacaaacctgacataaacgagaaatggggaaaggattccctatttaataaatggtgctgggaaaacgggctagcaatacgtagaaaactgaaactggatcccttccttacactttatataaaaattaattcaagatggattaaagacttacatgttagacctaaaaccataaaaaccctagaagaatacctaggcaataccattcaggccataggcatgggcaaagaattaatgactaaaacaccaatagcaatggcaacaaaagccaaaattgacaaatgggatctaattaaactagagagcttctgcacagcaaaagaaactaccatcagagtgaacagacaacctacagaatgggagaaaatttttacaatctacccatctgacaaagggctaatatccagaatctacaaataacttaaacaaatttatatgaaaaaatcaaaccccatcaaaaagtaggcaaaggatatgaacagacacttctcaaaagaagacatctatgcagccaacagacacatgaaaaaatgctcatcatcactggccatcagagaaatgcaaatcaaaaccacaatgagataccatctcacaccaattagaatggtgatcattaaaaagtcaggaaacaacaggtgctggagaggttatggagaaataggaatgcttttacactgttggtgggagtgtaaactagttcaatcattgtagaagacagtgtggcgattcctcaaggatctagaactagaaataccatttcacccagccatcccattactggtcatatacccaaaggattatgaatcatgctgctataaagacacatgcacacgtatgtttattgtggcactattcacaatagtaaagacttggaaccaacccaaatgcccatcaatgatagactggattaagaaaatgtggcacatatacaccatggaatactatgcagccataaaaaggatgagttcctgtcctttataaggacatggatgaagctagaaaccatcattctgagaaaactatcacaaggacagaaaaccaaacaccgcatgttctcactcataggtgggaattgaacaatgagaacacttggacacagggtggggaacatcacacactggggcctgtcatggagtgtggggagggaggggatagcattaggagatatatctaatgtaaatgacgagttaatgggtgcagcacaccaatatggcacatgtatgcatatgtaacaaacctgcatgttgtgcacatgtaccctagaacttaaagtataataacaaaaaaaactatgacactgtcctatataccatatctgtacaaaaattataaattttagatagccatccagagatacttctctacttcttggaaaaaatatcaacattgaaaacatcaaaaaaattaaacacttcttcttttgtccaaaaaaaaaaagaaagaaaaaagggaatcctccctaactcattttatgaggccagcatcatcctggtaccaaagcctggcagagacacaacaaaaaaagagaattttagaccaatatccctgatgaacatcgatgcaaaaatcctcaataaaatactggcaaaccgaatccagcagcacatcaaaaagcttatccaccacgatcaagtcggcttcatctctgggatgcaaggctggttcaacatatgtaactcaataaacataatccattacataaacagaaccaaagacaaaaaccacatgattatctcaatagatgcagaaaaggcctttgacaaaattcaacactccttcatgctaaaaactctcaataaactaggtattgatgggacgtatctcaaaataataagagctatttatgacaaacccacagccaatatcatactgaatgggcaaaaactggaagcattccttttgaaaaccggcacaagacaaggatgccctctctcaccactcctattcaacatggtgttggaagttctgaccagtgcaatcaggcaggagaaagaaataaatggtattcagttaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccattaatagacaaacagagagccaaatcatgagtgaactcccattcacaattgctacaaagagaataaaatacctaggaatccaacttacaagggttgtgaaggacctcttcaaggagaactacaaaccactgctcaacgaaataaaagaggacacaaacaaattgaagaatattccatgctcatggataggaagaatcaatatcatggaaatggccatactgcccgaagtaatttatagattcaatactatccccatcaagctactaatgactttcttcacagaattggaaaaaaaactgctttaaagttcatatggaaccaaaaaagagcctgcattgccaagacaatcctaagcaaaaagaacaaagctggaggcatcacactacctgacttcaaactgtactacaaggctgcactaaccaaaacagcatggtactggtaccaaaacagatatatagaccaatggaacagaacagaggcctcagaaataagaccacacatctacagccatctgatctttgacaaaactgagaaaaacaagaaatggggaaaggattgcctatttaataaatgatgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggccataggcatgggcgaggtcttcatgactaaaacaccaatagtaatggcaacagaagccaaaattgagaaatggaatctaactaaactaaagagcttctgcatagcaaaagaaactgccatcagagtgaaccaggcaacctacagaatgggagacaaattgcgatctacccatttgacaaagaaagaattcaaacaaatttacaagaaaaaaacaataccatcaaaaagtgggcaaagatatgaatagacacttctccaaagtagacatctatgcagctaacagacacatgaaaaaatgctcatcatcactggtcatcagagaaatgcaaatcaaaaccacaatgagatatcatctcatgccagttagaatggcaatcattaaaaagtcaggaaacaacagatgctggagagcatatggagaaataggaacacttttacactgttgatgggagtgtaaattagttcaaccattgtggaagacattgtggcgattcctcgaggatatagaactagaattaccatttgacccggcaatcccattactgggtatatacccaaaggattttaaatcatgctactataaagacacatgcacatgtatgtttatttcggcactattcacaatagcaaagacttgtaaccaacccaaatgtccatcaatgatggactggattaagacacgtgacacatatacaccatggaatactaatgcaatcataaaaaaggatgagttcatgtcctttgcagggagatagatgaagctggaaaccatcactctcagcaaaactatcacaaggacagaaaaccaaacaccgcatgttctcactcataggtgggaattgaacaatgagatcacttggacacagggctgggaacatcacacactggggcctgtcggggggtggagggctgggggagggagagcattaggagaaatacctaatgtaaatgatgagttgatgggtgcagcaaaccaacacggcacatgtatacctatgtatcaaacctgcatgttgtgcacctgtaccctagaacttaaggtataacaacaccaacaaaaaaagaagtttcttctaccagatgtcctcaatcatctctctcagtttcaaagttccataaatctctagggcaggggcaaaatgccaccagcctctttgctaaagcatagcaagagtgacctttacttcagttcccaacaagttctttatctccatctcagacctcctcagcctggacttcactgtccaagtcactatcagcagttcggtcaaagccattcaacaagtctctaggcagttccaaactttcccacatcttctggtcttcttctgagtcctcccaactgttccaccctctgcacattacacagctccaaagtcacttccacattctcaggtattttatagcattactccattaccttggtatcaaaatctgtattagtcatggttctctagagggatagaactaataggatatatgtatgtatgaaagggagtttattaaggagaattgaatcacaccatcacaaagtgaagtcccacaacacgtctgcaagttgaggggcaaggaatctagtattggctcagtccgagtcccaaaacctcaaaagtagggaaactgacaggccagctttgagtctctggatgaaggcctgagagtccctggaaaacaactggagtaagtccaagagtccaaaagccaaagaacctggagtctgatatttgagtgcaggaagcatccagcatgggagaaagatgagggccagaaagctcagcaagtcagcttctcctaaacttcttctgcctgctttattctagccatgctggcagctgattttatggtgccgacccacactgagggtggatctgcctctcccagtccactaaataaatgttaatctcctttggcaacaccctcacagacacaaccgggaacaatactttggatccttcaatccaatcaagttgacacttacttaatattaatcttcacaatgtaatattcatcccatttgtaatttttctttaatatacaagctccttgagaacatgcaccatttgatcttgtctctctgttttcttgggaggcagtggagaagagaagagttaaatgtgtgggtgtggagtcagactgccagatttgcatcttggctcccctacttactggatctctgaccttgagtaaattacttaacatctttctcagtttccttacctgtaaatgagtggtgacatatatggaacttagaacaagagccaagcaagtattcaataaaagctaatgttgttgcctactgtttattctcagtgtttggcatagtagccggcaaaaggaagaggaattttttttttctttttttcagacagtctccccctgtcacccaggctggagtgcagtggtgtgatcttggctcactgcaacctctgcctcttgggttcaagcaattcttgtgcctcagccccctgagtagctgggattacaggcctgtgccaccacacccagctaactttttgtatttttagtagagatggagctttgctatgttggccaggctggtcttgaactcatgtcctcaagtgatccacccactttggcctcccaaagtgttgggattataggcgtgagccattgggcccggcctggaaatatttttttgaaacatgactgataacagtattttttgaaagaatgacagataccaatcatgaaggaaaagattttcacaattgacaataaaaaactttaacttctgaatggtaaaaagagtgagaaaattaaaagccaaattacaaattgaaaaaactaaagtatataaaacaaaggttttcattctcaatttaatgcagaatcttgacaaatcaaaaagaacaaaaggtgaacccacctaaaagaaataggcaaaagacttccaagaaaagcaatttacaaaatgccaatgactaataaacatggatatttaacagcactagtattcaaaatacttcatttatagagatccctccttcacctatcaaattagcaaagatgaaaaaggctagtattaccaagttttgaagacaggtgagaggaaatgacaagtttatgtaccctggtaggacatgatattgtggcaatttgtttcagaacactcataaatgtagatatcttttagatcaacaattacacttttaagcttaagaaaatatgaagaataggtacaaatatttctctatatgttcaattaagtattattttttaaattaaaaaaaaattttttttgagacagtgtctcactctgttgcccaggctggatagctcactacggcctccgcctcctgggttcaagtgattcttctgcttcagcctcctgagtagctgggattacagatgcccaccaccatgcctggctaagttttgtatttttagtagagacagggtttcaccatgttggttggccaggctggtcttgaactcctgatctcaagtgatccacccttcttggcctcccaaagtgctgggattacaggcatgagccaccatgcctggccaattttttaattaaaaaaaatttttatagcagcacaactaagtattattttaatagtaaatattggagtcaagtttaattttgaacaggataagtaattatgatgcagcacattgaatactctttcattaagctaaacaactattaaaatgatatacaaatacatttactgaaaagaaacatgtttgtgatatacagttaagtgtaaaacaattcaggttataagaacatattaggccaggtgcgatgtctcacgcctgtaatcccagcactttgggaggccgaggcgggcggatcatgaggtcaggagattgagaccatcctggctaacatggtgaaaccctgtctctactaaaaatataaaaaaaattagccgggcgtggtggtgggtgcttatagtcccaactacttgggaggctgaggcaggagaatggcgtgaacccgggaggcagagcatgcagtgagccgagattgtgccactgcactccaacctgggtgacagagcaagactccgcctcaaaaaaaaaaaaaagaacatattggtcaatattcactgatttttataagaatatttgacagagagagagggggaagggaagggaaggggaaaggaaagggaaaggaagaagggaagaagggaagggaagggaatatgggtggatttatatcaaaaggttcagaaggaaatgattcttttcttctggatgtgactactgcagatttttttaacttttcctctttttcttatttatttatattttctgattttaagagaaactataaaactatatatattacttttcaacttaaaaatattttagtgcttcaataatgcagaagactcaatttcaacattgcagataattaaagcattactaaatgtggaaatgtttactttcacaatttctgtagtgatattcaagaccagatatcaccttggaatcagaactggtgcaggatcttgtcctaacactaccattaaggcatatggctgacccagctctgtatgtttaggttgtcttataatagagcaaccagttgtttattaggatggccaaaaaggcacatttcaaaaatgcctattaaaatattagtagtacaaataataccgctgaattttttctaatgagaactgataaaattccaaagcaatataagcagatacatagtaataatatggtttatcaaattaattgtcacatgattattaaaatgagatcatgtgtgttaagtagtggtatcttaagccactgaaatatcttccttggtctagaatgagctttctatggagattaaaaagatgttaaattgaacagtcttggttaataaatgaagaagcaaagccagaaaccctgtttaaagaagtaacaaaaaaggtcatgaatgatctagtggttgttatattttcttgtttacctgaggaaaagactatgctcaagcatgtattgaatccagtgatagccagaatgtcatccatactgctagcagccattaataaggttggaatgccttcctcaacaccatatccattttcttgcagcaccatcatgtaagggacaacaacagcaggagagacagcacctagaacaaaactgaaagaaagaatgaaaattaatttaaaagcatcttttaaatcaagtagtgttttataagtacaagtagtttataataactttataacaaacattgtttagaagaatttcaaatttgagtgaatgcaatttaatggtgataaaacttttcatgcattgtttagtgctggctaaaattttatacagatgtggtttaaaatgttgggctgaacacaggttgcagcctctccctctattcctaaatcctttgaagtgaagatgtaaaagtaatagaaaaattcataacctaaccagaaagcaaaaggtgaatccgcaatggacaagaaactaagtatatcccagtaagataagagacagacaatttaggattgaaaaaaggaaaccataaaccaaaatctgtgtaaataagattgcctcaaaagatacatgtgcttctaaaagtgctccaagccctgaaatggcagatgctgggagcaggagagacctctggggaaaccaaatagttaattatttggagtaccactgtaagaatggtcagacaaatctatcttccacacatttcctacctcttgagtaaataagtaagtaaggaaggaaggaacagagttgtctgcccaaaaaaacaagtgtggccacctaagttacaaaggcaaatgagaacatttctggagtggttgatgacacccatgaggaatggggaggctcctgctccgaataccttctattgacatatcttatccagaatttcgcctcatctcttctacatttactttataaaggctgaagtatatcctgtgtagaaatgcttttggtgctcctgccagaattgacctggtaaatgaacacatctcccagtgctgcttgttggctgctaatatctgcagatttctagaacccttgtcctgctgacaagcacctacctgggaatactagggaggttgtgcacccctctactttccctccagacagcatctgccaatgactgactgatgtgagtgtctaatagtttagcccatttgcttctggctgtacaacctctatggtgcagtttatgctacagatttccctgtgggctcaagaagagactagacttctctaagaccacatactggtctagttcagtggttcctaaactctgctgcacattgtaatcacctgttgtattatttttctcattttgcttaacaagtcatccccaaacatagcagcttaaaacaacaaatatttattgtcttatgacttctgtgggtcaggaatctgggcatggcttagctgtatgccttcacttaagatttcccatgaggtagggtggggtgggagaagatctgcttccaagtttactcatgtagctattgcaggcttcagttttttccaatggggttttctccacagggctgcctcaggacatggcagctggcttccccaggaataagtgatcaaagagaatttaatccataacatcaattaaaaacacaaaatatctaagaaaaaaactgtgaagatagtctatacttttataaaaattgtgaatataataatataataattaagataatacctgaatacttagagagacatttcacaagtgtgaactaaaaagcctcaattttaccatcgcccaacaccacgtctggctagtttttgtgtttttagtagatacggtgtttcaccattttggccaggctggtcttgaactcctgacttcaagtgatatgcccaccttggcctcccaaagtgctgggattataggtgtgagccaccatgcccggccaaagcctcaataatataaagatgtaatctctcccccaaataaattaatcagagatacaccaatcaaaatctttgcagggatttttactgagcttgacaagctgattataaaattcatttggaagaataagatcttagaacaaaagatcaagtaaacttaagaaaacaagatactgtttttgtaagggtaaaatagttaaaactgaataatagtgacatataaatagacaaaataaattggaagaaaagaaaatacaatgtgtggaaacaaatctatgggatttgttacatcatacaattggtattttaaatcagtgggagaaagaaagaaatctttcataaatggtgttgagataactatttatgtggaaaggaatatagatagatccttacacataataaatgttaaaagctcaaaaggaaaagtagtaataagaaaatgtagggggctaggtgcgatggctcacacctgtaatcccagcactttgggaggctgaggcggacagatcaggagtttgagaccagcctggccaacattgtgaaaccaatagctgggtgcagtggtgcatgcctgtagtcccagctacttggaaggttgaggcaggagaatcacttgaacccgggaggtggaggttgcagtgagctgagatcacgccactgcactacagcctgggtgacaggaagactctgtcacaaaaaaaaaaaaaaagaaaatgtagaataatatatttgtgatcatgaggtaaaaaggaccttttgaatgatacatacaaaggcattagacataaaaagagattttgatacattcaattatattaaagtagtacttcaaaagcaacttcaaaagtactacaataaagtactacttcaaaagcaattctgctctttctccccctttttttctttttcattttcaaagtcaagtgaatggtgttgtgtattggcaattctgtctgttgaaaataacaaaatacacttcttagagagaaaaaaaatcatcacaaacaaaattaaatatctagtgatatttgcaatacatataatttacaaatacatataacagatataattaataaagaagttgaagactcaacaaaaaaatggacaaaggatatgaacaggctagttacagataaggaaaagttgaaggacaacacatatataaaagatattcaagtttgtgaataatcacagaaatgcaaattaaaacaacaaaaatatgccattttttcaattatcagatgtgaaaacattataaaatttaataatatcaaggatttgcaaggattttcaagaacaacaggtatgctcataagctattggtattagggcaaattaaagtggccataccgaagggattttggcagtgtatatcaaactaaaaatgcatataacccaggtaactattctagacaaacttatatttaagtaaaatgagacaaataaaatgctatttttgttataacattgtaaataaaatctgctgttgacatacaatgtagtcttatacaattaaaaggaataaactacgtgtgtatccatcttgagatggataaacctcaagactattgttaagtgaaaagaacaaattgtaaagtaaaattttcttgggtatgattaagtaaaaatgcacaaaataatactcttttttttctctgggttcacaaatacacttgttagaagtccagaacattattttcaaagatctagaatggtaacataaaactcacgaagatgctgccactctgtccccagtggcacatgagtgcaccccacagcaccattgccctggctgacccatgcaagtatgcagaacaaccccatcccacacctgccggcactgcacccctgccaacacaggcatacctgctgtgtgctgctgctgctggcacatatgtgtgagtagggaccttgctacaatcactacaatgaagcactctggctggcacaccccatcagagtgttgttgccagtggactgggaacacctcagtgcttaacactgaagggccagacaacaaatctgtgggtatggtaccagccctgcaaagttagagcatgcagctcaggagtgctgagctgagcctttgccccctgaaatcttccagaaatgaagccatttgactgaacctaccttgtgccacagtcaaaccctcaagggcattaaagaatataaaaaaggaaaaagctccatccaaaggacagtgactcaaaacattaaaggaaccttagcccacacagatgtgaaagaaccagtgcaaaaactggcaatgtaaaaagccagaatgtcttcctgtcttcaagcaatcatactaactctctaacaatggttgttaaccaggattaaatgacagacatagaattcagaatctggatagaaacaaagatcattgagattcagaagaaagtcaaaatccaatccaaataatctaaggaatccaataagatgacataagagctgaaagatgaaataggcattttaagaaagaaccaaactaaactgatagagctgaaaaatgcgcctcaagaatttcataatacaataacaagtactaacagcagaacagaccaagctgagaaaagaatcttagatctcaaagaccacttctttgaattaactcagtcagatgaaaataaagaacaagaaagaatgaacaaaacctctgagaaatctgagattatgtaaagagaccaaacatatgactcaaggcatcactcaaagaaagggagaaagaataagcaagttggaaaacatatttgaggatactgcccacaaaaatttcccaaatcttgctagagaagtcaccatttaaatccaggaaatgcagagaacccctgtgagatactacataagatgaccatccccaagacatccccaagtcatcagattctccaaggtcaacatgaaagaaaaaaacatgaaaggcagctaaagtgaaggggcaggtcacctacaaagggaatcccatcaggctaacagtggaactgtaagatactctacaatccaaaagaaattgggggcctatattcagcattctttctttttgtttttgagatggagtctcactctgttgcccaggctagagtggactggtgctatcttggctcactgcaacctccacttcccgggttcaagcgattcttctgcctcagcctcccaagtagctgggactacaggtgcgcaccacaacacctggcaattttttgtaattttagtagagacgggatttcaccatattggccagggtggtctcaaattcccaacctcgtgatctgcccacctcggcctctcaaagtgctgggattacaggtatgagccaccatgcctggccttcagcattcttaaaaaaaaaaaaaaaaaaaaaaaaaaaaacttggctgggtgtggtggctcatgcctgtaatcccagcactttgggaggctgaggggggtggatcacaaggtcaagagatcaagaccatcctggccaacacggtgaaaccccatctctactaaaaatacaaaaattagctgggcatggtgatgcgtgtctgtagtcccagctactcgggaggctgaggcaggagaatcacttaacccaggaggtggaggttgcagtgagctgagatagcaccactgcactccagcctggcgacagagcaacactctgtcgccaaaaaaaaaaaaaaaaaaaaaattcaaccaagaacttaatatccagccaaactaaacttcatattgaaggagaagtaagatccttttcagacaaacaaatgctaagggaatctgttaccaccagacatgccttacaagaggtccttaaaggagtgctaagtgtggaagtgaaggactgttaatggccaccacaaaaatacgtttaagtacatagaacattgacattgtaaagtaactacacaatcaagtctgcataataaccagctaacaacataatgacaggaccaaagctataaatatcaatattaactgtgaatgtaaacagtataaacgccccacttaaaactcacagaatggcaagttggataaagaagcaaagcccaactgtatctgctgtcaagagacccagctcatatgcaacgatacccattggctcaaagtaaaaggatggaaaaaaatctagcaagcaaatgcaaaacaaaaaagggtaagcattgttatcctaattcagacaaaatagactttaaaccaacaacaatcaaaaagacaaagaagggcactacgtaatgataaagggttcaattcaacaagaagacttaactgtctaaaagataaatgtgctcaaaactggagcattcagattcataaaacaagttcatagagacctatagagaaacttagataaccacagaataatagtgggagacttcaacatctcactgacagtactagacagatcaaagagacagaaaatgaacaaagatattcaggacttgaagtcaacacttggctaaatggacctaacagccatctacagaacactccacccaacaacaacagaatatatgttcctctcatctgtacatggcatatattgtaaaattgatcacactatcagtctaaaattattttcaataaatttaagaaaacccctgaaatcaggccaaccacactcttggacccgcagtgtaataaaaatagaagtcaacactaagacgaactctcaaaaccatacaattacatggaaattaaacaacctgtgcctgaatgacttttgggtaaacaatgaaattaaggcagaaaccaataaattctttataactaattaaaacaaagatacaacattctcggctctctaagacacaggcaaagcagtgttaagggaaaagtttatagtgctaaatgcccatattgaaaagttagaaggatcttaaattaacaacctaatatcatacctaaaggaaacagaaaaacgagaggaaaccatcccaaagctagcagaagaaaagaaataaccaaaatcagagcagaatggaatgaaattgagtcatgaaaagccatacaaaagataaatgaaactaaaagctggttcttcgagagaataaataaattggataggtcactagctagaccaataaggaaaaaaaaaaaagagagagagaagatccaaaaaacacaatcagaaatggcaaagtggacgttaccgccaaccacacagaaatacaaaaaactctcagagactacgatgaacatcttcatgcaaacaaagtagaacacctatgagaaattggtaaatttctggaaacatacaacttcccaagattgaactaggaagaaactgaaatcctgaacaaatcaaaaatgagttctgaaactgaatgagtaataaaaagtctctgagccaaaaaaaaaaaaaaaaaaaaaagcaagcccaggacccaacagattcacagacaaattctaccagaagtgtaaagaagagctggtaccaatgctactgaaattattccaaaaaaatgaggaggaaggatccctccctaactcattttatgaggccagcatcattcagatatgaaaacctggcagagacacaacaaaaaagaaaacttcaggacagttatcactgatgatcatagatgcaaaaatcctcaacaaaatacaagccaactgaatccagcagcatatcaaaaagctagtccactatgattaagtaagctttatccctgggatgcaagtttggttcaagatatacaaaccaataaatgtgattcatcatataatagaactaaaaataaaaacatcccttcatgatatagaccctcaacaaatgagttactgaaggagcatacctcaaaataattggagccatttatgacaaaaccacagccaacttcatactgaatgggaaaaagctggaatactccctttgagaactggaacaagacaaggatgcccactctcactactcctattcaacatagtaatggatgtcctagccagtgcaattaggcaagagaaagaaacacagacatctaaataggaagaatggaagccaaactatgcctcttcataggtgaaacacttttataccaagaaaaccccatagtagcctctcaagagctcccagatctgacaaatgacttcagcaaagtttcaggttacaaaactcaatgtacaaaaatctgtagcatttctatacaccaacaacatccaagctgaaagccaaatcaagaatgcaatcccattcacaatagccacaaaaaaactataaaataccttggaatacagctaagcagggaggtgaaatatctctacaatgaaaattacaaacgagtgctcaaagaatcagagacaacagaaacaaaaggaaaacattccatgatcacagataggaagaagcaatattgttaaaatggccatactgcctaaggctatttacagagtcaatgctattcctatcatactatcaatgacatttttcacaggattaaaaaaagcatcctaaaattcatttggagccaaaaaaacaaacaaacaaaaaaagcccaaatagccaaagcaatcctaagcaaaaagaacaaagccaaaagcatcacactacctgacttcgaacggtagtacaatgctacagtaagcaaaacagcatggttatgctcagcaaaagaaataatcagcagagtaaaaagacaacctatagagtgggagaaaatctttacaaactatgcatccaacaaagtactaatatccagaatctataaggaactcaaaaacagacatagaccagtggaacaggttacagaacgcagaaataaagccgcacacctatagccatctactcttcaacaaacttgacaaaaacaagcaatggggaaaggaatccctactcggaaattgtgctgggataactggctagccatatgcagaaaactgaaactggactccatacgtttcaccgtttacaaaaatcacctcaagatagattaaagacttaaatgtaaaacccaaaactataaaaaccctggaagatatcctaagaaataccattctggacacaggccattctggacatatcctaggaaatttcaattctggaaaacactttatgatgaagacgccaaaaacaattgcaacaaaaacaaaaattgacaaatgggatctaattaaactaaagggcttctgcacagcaaaggaaatcatcaacaaaccacctatggaatgggagaaaatatttgcaaaccatgcattcgacaaaagtctaatatccagaatccaaaaagaacttagaaaaatcaacaagcaaaaacctaacaaccccattaaatgggcaaaggagaggaccagacacttctcaaaagaagacaaacacgtagtcaacaagtatatggaaaaatattcaacatcactaacattagagaaatgcaaaacaaaactgcagtgagatacaacctcacaggaggcagaatggctattatcaaaaagtcaaaaagtaacagatgctggcgagcttggggagctactcccaggtctttggaaggctgaggcatgagaattgcttgaacctgggaggcagaggttgcagtgagctgagattgggccattgtactctagcctgggcaacagagcaagactccgtctcaaaaaaaaaaaaaaaaaaaaaacccgagagagagagagaaagaaaaacccacagccagcattatactgaatggggaaaagttgaaagcattcccccgagaactggaacaagacaaggatgcccagtttcaccacttctattcaacatagtactggaagtcctagccagagcaatcagacaagagaaagaaataaagggcatccaaatcagtaaagaggaagtcaaactgttgctattcatgattatatgatcatataatgagaaaaccctaaagactcatccaaaaagctcctagatctgataaatgaattcagtaacgtttcaggatacaaaatcaatgtacacaaatcagtagcactggtatacaccgatggtgactgagctgagaattaagtcaagatctcaaccccttttacaacagctgcaaaaacaaacaaacaaacaacaaacaaacaaacaaaaccaaagaaaaaaccccaagcaaacgaacttaggaatatacctaaccaaggaggtgaaagacttctacagtgaaaactacaaaacactgcagaaagaaatcatagatgacacaaacaaatagaaacacatcacacgctcatggataggtagaatcaatattgtgaaaatgaccatactgccaaaaacaatctacatcatcattcttccctgaactagaaaaagcaatcctaaaattaatgtggagcccaaaaatagcccgcataaccaaagcaagactaagcaaaaagaacaaatgtggatgcatcacattacttgacttcaaactatactataaggctatagtcaccaaagcagcataacactggtataaaaataggcacatagaccaatggaacagaatagagaactgagaaataaagccaaatacttaagccaactgatctttaacaaaggaaacaaaaacataaagttgggaaaggacaccctattcaacaaatggtgctgggataattggcaagccatatgtagaagaatgaaactggatcctcatctctcaccttatacaaaaatcaactcaagatggatcaaagacttaaatctaacacctgaaactataaaaattctagaaggtaacattggaaatacccttctagacatttgcttaggcaaagacttcatgaccaagaacccaagagcaaaggcaacaaaaacaaagataaatagatgggacttaattaaactaagaagcttctacacagcaaaagaaataatcagcagagtaaaaagacaacctatagagtgggagaaaatgtttacaaactatgcatccaacaaagtactaatatccagaatctataaggaactctaacaaatcagcaagaaaaaaccaaattatcctatcaaaaagtgtgctaaggacatgaatagacacttcccaaaagaagatatataaatggccaagaaacatgaaaaaatcctcaatatcactaattattagggaaatgcaaacaaaaccacaatgcaataccatctcactcctccaagaatagccataatcaaaaaaataaaaaaaaaaaatagatgttgccatgggtgtagtaaaaaggaacactttcacactgctggggggaatgtaaactagtacaaccactatggaaaagagtatgaagatttcttaaataattaaaagtagatctaccatttgatctagcaatcccaatactgggtatctacccagaggaaaagaagtcattatatgaaaaaaacacttgcacacgcatgtttattgcagcacaatttgcaattgcaaaaaatacggaactagctcaaatgcccatcaatcaatgaatgcatacagaaaatgtggtgtatatatacgtatctatgtgtatatatgtgtatgtatacacacacacacacacacacacacacacacaccatcgacagaatactactcagccataaaaaggaatgaaataatggcattcacagcaacctggaaggagtcggagaccattattctaagtgaagtaattcaggaatgaaaaaaccaaacattgtatgttctgacttataagtgggagttatgctatgaggatgcaaaagcgtaagaatgatacaatgggctttggggacttagggggaagagtaggaggagggtgagcgataaaagactacaccttgggtgcagtgtacactgctctggtgatgggtgcaccaaaatctcagaaattaccactaaaaatattttccatgtaaacaaacaccacctgttccttaaaaactaatgaaaaaagaaaaaagacatgagatcaacctaaatgcccatcaatggtgaactggataaagaaaatgtggcacataggagggggtatatctcagggttagagcatcagactgcggaccaagaaaatgtggcacatatacaccatagaataatacacagccacaagaaagaacgagatcatgtcctttggagcaacgtggatggagttgaggccattatcctaagtgaattaacacaggaacaggaaaccaaatatcccatattcttacttataagtgggagctaaacactgagtacacatggacagaaagaagggaacaatcgtcactaggtgaatttgagggtggagggtggaaggagggggagaatagaaaaactacctattgggtattatacttattacctgggtgacaaaataatctgcataccaaacccctgtgacatgcaatttatccatataacaagcctgctcatgtaccccttgagccgaaataaaaattggagaagaaaaaaactcgtaagagttgtcactttgggtagagttatgggcattatgatttgaaggcatattctaaggtcattcctcctttatttataaagttctaatttttaaaataaaagtgcatttgagtattttatcataaacattaatttaagaattcactggattttgtagtaactatgtaatggatgaactttgctatgagtgtcattggaatggataagcagagacaaaagttgatgaattaagaaatgaaaaggagttaggatctagagacagtagttacagacttattttgaggaattcaaacataagacaaatggatggtagataaagatggatggggcattggatatacggcaagagtttttgtttgcttgctttctttaaaatgggagagtttatatttatacacctatgtctatataaaatgtttctcaaatatacttatatatatacacatacatatatatgaaatgtgcaactgtacttacatacagctatgaggaagaggccattagatagattaaaacatacagatatgttataatacagatgaaaaggaataaattgatcatgtgaattttcttgatgataaacatttaggggctatgaatgtttgttaaaaaaatttcgtacaatttgggacatggctctgcttttaatcaactgctttccaaggattttaacactgaaacgaattttaatagagcttttctatacaacattctgaatattttaacagttttaatgaagcatccttaattgaatattttcataagaaaaaatgagaaagaaattaccctaatagaaatgcccattgccagggaaatttcataatgaagtgtgaaaaaacagcagctgcacttgcctccataaggcatggacctacagccaatctgaaacaaacgaccttcaaatgcctcaaagcctgaaacacaaaacagtcacacttagatacatttacaatggccaacaagaaaattattttaacaaatgtcaaactataaagtcttttttcataagaagctttcactaaacgaaatctcatttcaacagattgtcccactggactttgaactctattacattttatatgtcatcataggttggattataaacaatttcatctttttaaaaatattattatattttaattattaaaagatcaattttactgtgattaaatagctaatgctaccttcctgaactttcctaataaatagtataataatagtgtcctattagtgttttcccattaactttttgatatgaactgtttgattaacttaataagtataaatagaataccaacatgccaaagaaaataacttaaaaactgcataattcattttaaaagggagaacttttcaatgttctccttggttcatactttctgctggagaatataatcttattggctataattatttatgctcttgagctatttctattaaaccacatttgccacatttatttgagtggctgtcatattcatgaatagtcatcttcttatagatgggatttatgatccctagaatgtaatattttaagaaatgctttaaaagattggattttacaataatgcaaagataatcaggaacataatcctgtggagaaaatgtcataaaaaaattactgaaatccttaatctccctaaaaaaagaaaaagacttttataaggtttttcttatcctatgttaactgaaaagtacatacttctccatagaagagcctcccaaataatataggtgctatataagagacatttatctctgtgcaaatgattagatcgctaataaagaccttacaacacagtcaattctcttcatatcagtgataatgatggctagacatagaaattagggtgccaatatttctatacagtctttttttcttctgtttttttcttctgtttgtttgttttgttttgttttttgagacggagtctcgctctgtcccccaggctggagtgcagtggcactatctcagctcactgcaacctccgtctctcaggttcaagcaattctcttgcctcagcctcccgagtagctgggattactaggtaaatgccaccagcccggctaatttttgtagattacaggcatgagccgccatgcccggcctttttttctttatcttaggtttgtttacagactctatttggaacaggaaaataaaatttttgcttctttttctttctcaccgtcctctaatatttgaaataaccttactcgatttgtaattgtaaatctacctgtggatcgagtccaagcccagctcttattagaataatggtaagggcaatgcttcttaaaattgaagaccatgtgttaggaacatggacatgttcattgatgaatggaacattcctaatcgtaaaaccagccagtaacatcccttaaaagaaagaaaataaagatacatgacagttcatttttctgagaaagaaaacggaaatgtttactttcttttctaatgcactatgtctctcattattttggtaaagggcaggttacaagcaagtagagaaggcagcatgaataaaggaatggcgataagaaacaatacacctaaatggggttcaacaagtaagttagtgttgctggaacatacagggcaaggaaaggagggaggagaatgagcttgggtgggccagatcatagaaaggtctccccccactttggcaaagtaaggcaccatgggaaggttttaggcaggaagtaacataatgagtcttgcgttttttatgtgagggtcttggtgaattagtttgggataaaactggagacagagaccaaattgaaggctctgccacagtccacgcaaaagttggaaacaaatagcctaagctagagcaaaagagaaagtttggagaggaggaaaatgattcaataaatacttagaaggtgctgtaagaaaattgtggatacagaagggacagcagagataagatgtagagattatctctactgacagtgtactgaatatatatttatttttgaggacagggtctcattctgttgtccaaggtgagtgcagtgatgcaaacatggctcactgtaggcttaacctcctgagctcaagtgatcctcttgccttagcctcctgagtagctgagacccagaaaaatttttaatattttgtaaagacaaggtctgctatattgcccaggctggttttgaactcctgggctcaggtggtcctcctgccttggcctcccaaagtgctgggattatgggcatgagccaccgtgcctggcccactgtactgaatatttagatatatttgaatacagtaagttctcacttaacatcatcaataggttattggaaatggcaactttgagtaaaatggtatataacaaaaccaattttagcataggctaaatgatataaacaacagtcaatttcctacagcatatttccggtcacaaaacatcaccaaacttctaaataaagatccaaaacacttctagtattaaacaatgaaataaatgtgagctctacatacactttagaaagttttataaaaacaaataagataattatttacttaatttttggtgaatccatgagtgatggtggttatagcggtgatggttaaaatcaaagaataaatgtttacaaagtgaaaattgtaaggagcacctcctcccactatgcagttcaaaaacaatcacaaatatggtaggctggctgagagttttcatatcacattgtctattgtcatgcatttgtatggttaccatatacttaacaaaattttattttacaataatttgtattcattcatttattcatcgtacaatccacttattctagttcagggtcaaaggtgactgaaacttaatccaaaaaaatcaaggagggactccctccctaacacattccatgaatctagtatcacagttatacccgaatcaggcaaagccatacacacacacacacacacacacacacacacacacacacacactactggtcaatatccctgatgaacatagatgcaaaaattctgaactagcaaaatgaattcaatagtacatcaaaaagataatatagttaagtggattttactccagaaatacaaggatggttcaacatgtgaatcattcttccataaatacatatacacacatatgttcattgtagcactattcacaataaaaggacatggaatcaacttaaatgactaaataaagaaaatgtggtacatatacaccatggaatgctatgcattcataaaaaagaatgacatcatgtcctttgcagcaacatggataaagctgaacaccattatcctaagtgaaacaactcagaaacagaaaaatcaaataccacatgttctcacttatatgtgggcactaaacaatgggtacatatggacctaaagatggaaataatagacactggggagtccaaaaggagagagggttggagggttaaggttgaaaaattacctattgggtatagtattcactatttggtgatgggttcactagagcccaaatgtcaccattatgcaatatatccatgtaccaaacctgcatatgtaccccgtgaatctaaaatttttaaagattctattaaacaataaagcaacaggaataatgtactaaggatattaaatttattttaaaaataaattttggataaaacttgtgtgtatatatgtagacagagaaataaatgcatctataaaggagctgtacacacacacacacatacagtaaatacatacatgaagaaactatataaaacatactacattgaaatatttctgaattataactaattcaacaagaaaatgttcaacatttgcatatagtcaataataaagaaaagagagctaattatatacttaccaagaagaggtggaagtggaggcactaaaggtattctaatgagttgtaaaatttttcccccaataatggcactataaaaaataatgaacaacccaaataaatttccaccagggagagcttcagagcctaagattgaccaggtcatacaccatatcacaaacagtataactcctgaaatacaaaaaagtgtacagctatatatctacatacacatagatgtatacaaacaaaggatcaattctcttttatcatatatactaatagccagttttataaaatgatacatggtatagatcaacattgcttactagtttggtgaaagagatatctgcttaacatatattccaaataacctgtcaatttatgaagtaggtttcaaacaaagtgtttttactttaaaaatatttaaaacctatatgtgggccaggtgcagtggctcacaccttaatcccagcactttgggaggctgaggcaggctggatcacatgaggttcaggagtttgaggccagcctggccaacacagtgaaatcccgtctctactaaaaatacaaaaattagccaggcgtggtggtgcgtgcctgtaatcccagctacatgggaggctgggtcaggagaattgcttgaacccgggaggtggaggttgcagtgagccaagattgtgccactgcattccagcctgtgtgacagagtgagactcagtctcaataaaaaaataaaaaaataaaaaaaacctatatgtgaactctggaaaatgctaaccattataatatatgatagttaaaaacatcatggcaatatgatgagatttacttcattttatattttaaaatagctttttcatcaggatggaaaataagaggatgactggctgtgataagaattcacaaccttattgaagatcacagtgtcaaggtgccaaatcttttaagaggaacctactaaatctttgtattgaaaggataattcaactgatatttggcataaatgtattagaggaggtaatggctggaagaaatgaacctagattttgtgggaataaatataaagtatcttagattatgtgtaggaagtagaggtagataagatgagtaggtataagttactagacatcttgtttctggcaactaggtgctactcactgaggaatccataggtttctataaaggacagacaataacatggtaaatttccatatgctaattaaattgctacctttatttgctatgaatcataattgctaatgcttttaatattcttaaaacagtttatatgcattttttagctatgacccctttccggctgtatagaatttgccagggtaaaagaggacgattttgactcactccaggcagaaagttagaacaaagtatctctttcctcctcccctctgattattgtcatcctgcaaaactggaagccttggagggctaaactcttactaaaagaatggaccaggctgggcatggtggctcatgcctgtaatcccagcactttgggaggctgaggcaggtggatcacctgagctcaggagttcaaaatgagcctgaccaacatggtgaaacgctgtctctattaaaaatacaaacaattagcctggcctgttggcgcatgcctataatcccagctacttgggaggctgaggtaggagaattgcttaaacccaggaggcagacattgcagtgagctgggatggcgccacttcactccagcctaggtaacaagagcaaaactccatctcaagaaaacaaaacaaaacaaaacagaaaacaaaacaaaacaaaacacggacaagaaaatgtcatcctactgacaaattgagaagacaaggcagtttgtcttagctggtctctgggtggcaaagtcttttttgagaattcataggtaaaactggcctcatccaacttatgtgtagggctcaaattacattatgtgcacaggttagggatcccaaagttctaaacctaccataaaagtgtccctgcatagaagtatccctagaacacacttagtagatgctaattcaaaaaatctctaatagacagtcctgatcccagactgcataaagtctcaaaggtaaagccaagtgaatctgaacttaaaataagaagaaatatcccatgagcaaaagttaacagatactacaaagaatgggattagatgtctgaaaaccttagctaatagaaccactagatagacactataaaatatgtattttcaaagggactagagacaatttttaaaaattggagacatgagaagaagaaattacttgaaagcattgtaaaataattaaatagaacatctagaaaaaactgtaaaatttactcaactaaaaaaaaaaccactaagtacccaaacagcagtctagacatggctgaagagagaacacagcaaagtagtagatatgaggaaattacttaagagcatagcacacacacacaaaaaaatgaggtggaaaatgagagatttagattatggaaaagatctaaaacacaactaatagtagtttcagaaacataattgaaagaatgaagaagatataatatttgagaagaaaactggcttcaaactttacagaattgattagggtttttattgatttggacacaggaagtcaaatgagttctaatcaggattaagtaaaaatagatacttagataaaatgttgagaaactatagactaccaaaggcaaaaataaaatcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatcgccattctaactggtgtgagatgatatctcatagtggttttgatttgcatttctctgatggccagtgatgatgagcatttcttcatgtgtttttttggctgcataaatgtcttcttttgagaagtgtctgttcatgtccttcgcccactttttgatggggttgtttgtttttttcttgtaaatttgtttgagttcattgtagattctggatattagtcctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgatttcgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgctggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctcaggcaaaaataaaatcttaaagaatctagacagagaaaaagagattaatcataatcgaataaacaatagagcagattctcagtacttatcagcaacaatagaagatggaagataaataaagtcttcaaagtacagagataaagaaatcattcaatgttgaattctgtagccagttaactgtcactcaaacaaaagacaaatgaaagatattgtcaaacaaatacatttaagaacatatgccattttttaccagggaaaaatctactgaaagatatgctttagaaatatgacatagaaccaaaaaggaaggaacaatgtgcaaagaaattggtaaaatgtaggttagtctaaacaagtactggttgtgtaacacattactaatgaaaattgttaatcagaggatataaagataaggttgggaggtgacatgaaaaggttggcaatttatttccacaccaaaactccccccaaaaattgcaaaaataccaaaaacaaacatttcaggaccctgaaaactcatcaaaggcagttatcaaattaagaagcatttatccttgaaaaaagtgttagggttttgggtaggattggtaaaagtctgagcccttcctgactggggttgctccctgatatggtttggctttgtgtccccatccaaatctcatcttgaattgtactcccacaattcccacgtgttgtgggagataattgaatcatgggggtggttccccccatactgttctcgtggtagtgaataagtctcacaagatctgatggctttatcaggggtttctgcttttgcatcttcctcattttctcttgccgccaccatgtaagaagtgcctttcacctcccgacatgattctgaggcctccccagccatctggaactataagtccaattaaacctctttttcttcccagtcttgggtatgtctttatcagcagaatgaaaacggactaatacactctcatctctcttctcatccccaagctcagctgggaaaaacagtagttttaccagtttgaagctggatgtaaaacccagcagctttcctgttagggctgggggcaggggtggatttggtatggagtagagggaagaaatcaatggttttgccagttaaatatagcagagtggtttgagaatgaacagacagaattgcagctttgctagtctgaggttgcagtttcaattggggaagtggaagacaagacaaaaatttaaatgagagatcctgagggtcaataggtgcagcaaaccaccatggcacatgtatacctgtgtaacaaagctgcacgttctgcacatgtatcctggaactcaaagtaaaattaaaaaagaaagaaagagagagagagaaacaacaaacaaagtggaagaaagaaagagagagagaaagaaagaaagaaagaaagaaagaaagaaagaaagaaagaaagaaagaaagaaagagagagaaagacccacatgcaaggctagagttttccagttccaagttccaattctctcactgagaagagtggctcacggtgcctaaactgtttatacaaacaatatggtttactctgaacagctgcttttcttctgggagtctggaattctggtacatgtgaaggacagtaacctccgtaaaatcctgagtactgagtctctaatgagactctggtcctggtagacgacattgcacatgtgctgtcaaaatttcatgctggggaagagaaacacatccttgtaactccacaggagatgattccaggaagtttgtgcctggtatcctccagactttaccacacacaactttttccctttgctaattttgctttgtatccattcactataataaattaaaaacctgagtattactaaaaaaaaaaaaaaaagactgatcctggaaaggagagaataatagaaagtttgtgataagttctccacacatatatggccgattggaaaagtatggaagtgcaggaaagactcaagagagtatgacaaaaagtaaaaatgaagtaagacttgagtattaattgcaactttgaatgcattcacccacccacccacagattatttggcagacagtggaagccttactagctttaacataatgtctctccaaaatcaagctatgcaacagacacaaaggaaatccctagaaagacaggctaaaacaacaataacaacaacaacacaatataaaagacatcactgctgaaaaccactgggcagaaggattacacagcacatgtataggccaattaccaaaacaataacaacaacaaaaacaatcacaaataaaaaccaaatccagatttgctataatgtgtaattaaagtgtttagttttcaattaaaaattatcagacatgtaaggaaacaggaaaatatggttcatactctggaaaaaaagcagtgaatagaaactctcaattcagatactggatttagaaagaaagttttcaaagtatatattataaatatgttcaaattaaaaatatgataatgtgctgtctaatagagaacatgaataaggagacagaatatatttaaaaatagaatctagaatcgaaaagtacaacagttaaagtgaaaaaatcactagcgaggttcagtagcatatttgaccttgtgaaagaaagtatcagtgaacttgaagatagaccaatagaggttaatcaatctgaagaacaaaaagaaaaaagaacgaagaataataaacagatcctcagaaacttatgggataccatcaagagcactaacatatgcataatgggaattccaggagaagagagagataagagggcagaaaaatatttgaaaacataatgtctgaaaacttcaaaaatgttatgaaaaacattaatcttcaaatataagaagttcaacaaatctcaagtaggataaacacaaagagattcacacctagagccatcatagtcaaattggtgaaaaccaaggataataagaaaatcatgaaaatagcaagagatgacttatcacatacaggggaacaataatatgatcaatactggcatttttatctgaaaaaaatggaggccttatgaagcgacatttcaaaagtggagggaaaaataactgtcaattaagaattcggtatccagttaaatgatccttcaaaaatggagctgaaataaagacatttccagataaataaaaataaagagaacttatccttgctaaagaaacactaaataaaatgcttttaagataaaaggatatgacaccagatggcaacttgaacctataaggaataaacggcactggaagtggtaaataaatttgtaagtataaaagattgtatgtgtgtatgtgtgtatatgtgtgtgtgtgtgtgtgtgtgtattctgatttcatctcttttttaaaaaaagcatctgattattataggcaataactataacaatactgctgagttcatagcatataagaggtacattggatcaaagttgctatataacactggaattaagtaaaaattattaaaccaaagtagattgtaaaaagtgaagatgattgattattataacccccaaaggtacttgggaggctgagatagaagtattgcttgaggctaggagtttgagactagcctaagtaacacaatgaaactctgttgatatagtttggatatgtgtccctgcccaaatctcatgttgaattgtaatccccaatgttggagataggtcctgctgggaggtgaatggatcatgggggcagatttctcctgaatggttagtaccatcctcttggtgctgtccttgggacagtgagtaaattcttgtgagatctcgtcatttaaaagtgtgtggcactgccccttgctcttttactcctgctttcgctatgtgacatgtctttgccttctgccatgattgtaagcttcctgaagccttcccagaagcagatgcctgcatgcttcctgtacagcctgaagaactgtgaggcaattaaaccacttataaattatcgagtctcaggtatttgaaagcaatgcaagaatggactaatacacctgtctctaaaaaatttaagcaaaattacccaggtgtgatgacacatgcctgtagtcccagctacttgacaggcaaaggtgagaggactgattgagcccaggagtttgaggctgcaataagctatgaccatgccattgtctcttaaaaaagtaagccccagagaggccaggcgcagtggctcatacctgtaatcccagcactttgggaggccgtggtgggcggatcacaaggtcaggagatggagaccatcctggctaacatggtgaaaccccgtgtctactaaaaatacaaaaaaattagccgggcatggtggcaggcacctgtagtcccagctacttgggaggctgaggcaggagaatggcgtgaactcgggaggtggagcttgcagtgagccgagatcccaccactgcactccagcctgggtgacagaacgagactccgtctcaagaaaaaaaaaaatcaacagagaaattgaaatagggcactaaaaatacttggttaacatgaaagaagcagtaatgtaagaaaagaaaaacaaaaagacatgacacatagaaaacaaataacaaaatgttaaatgcaagtccaaccatatcaataattatgtgaatggactaaaataaaaaggcaactattactgtacaggactttaaaaaaacaagattcagctatatggtgcctacaagaaacaaactttagataaaacaagcaggttgaatgtaaaaggataggagattaggagacatacatatatatatacacacacacacacacacacacatacgcaaatggtaattatggggaaagaagaaaacataagtgtaattactatatatatgtaatttttttaacctgtaagtcagttttattatctgtaaaatggggataaaaaaattatctcctgccaacataaataggttttgttacaataaaatgaactagtgagcatgaaagaacattgcaatctgttaagatgttcttccaggaattcttgcattctaggaaaatcagaacatttctggttatagaatttttgacattttgaggaaagatattttttaggatatatgtgaaaagaacactttatcttctctaattacatcatggattctctttttgcattgagattttgcttgaatatcaatagacaagacaagggagtggttcaggcacttgtctagtgagcggatcgctgacaggaagcaaggagccagaaggacactcccctgtgctgttggtcaggggcccgcttggctggtgccaaggatttgttctcagtgacaagacaaatacagaaatggagagtggttacaaacttctatagcaatttgacactgtattttataaaaagtaaatatcagtctacatcaaataggaaattaaaaacaaaaacaattgggtattaatctactaagcttagtccctaggtgacaaaataatctgtgcaacaaatccacatgacacaagtttacctatgttacaaacctgaacatgcacccctgaacccaaaataaaagtttttttttttaaaagaaaaacaaaacaaaaaaaccacatctgtttcttcatcacagataatttgagaagcactagtgtcaggaaaaaagaataataaataatatgtacattaaaactcaccagaaaacatatatgcactgggatatctttttggacattaaagaaatgtgaaaaatcacacatatattcctaatgaacttgactatattatatatatatgtttatttagaagtattaaattgaattaagtattaaatttattttttaataagtggtataaaggaaggatgttctgattaagaaggataggtaaagggcaattacaactctgggtagagaaatagtaaaatggccagaaacagactggcaaaggctatggagtaattaatctcacaaaaggaagcagaatttattaatataaataacatagtattgctgatacttaaataattgtgagttatattgaagaattattttatattttaaaatagcaaaaccccccaaaaaacagtgtggtaaagctgtggtgaggtttgtacattttaggaagccttgttatttttagctcatatggttttttgataagtaaaaatttaaaaaaagttaaaaatgatttctctgctgcttaaattccgatacacatctattgagtggtaagatatgagtttagagtcactgtatttttttagtagttctactaataagaaattttcattaagctttactttctttctttctttctttttttttttttgagatggagttttgctcttgttgcccaggctggagtgcaatggcatgatctcggctcaccacaacctccgcctcccgggttcaagcgattctcctgcctcagcctcccgagtagctgggattacaggcatgcagcaccatacccggctaatttggtatttttagtagagacagggtttctccatgttggtcaggctgctcttgaactcccgacctcaggtgatccgcccgcctcagcctcccaaagtgctgggattacaggcatgagccaccgtgactggcctaagctttactttctaaaaattatatcaaaattggtatttctctattatgtaatcataaattatatcaaatatgctgttttgaattttatttttccctttaaacataaagacacacattcagttcattgtgctatataaattaccagtgtgatcacaaattaagaaatgcaattcaaagaattttgcgtacaaggagtcctgaaagtgttaataacttttgatgcaaagataattttatgaaagtaatagaagactaaaaaaaggtacaaaacaattattatgtaagtatcttcctttttctgaatcacccatgattactttttccaccaagcaaaaactgactacatacttcagatctgtctcaaatctccccagcctcttttcctaaacctccccagcctctcaggacagacaggctgctcctgtactttgtgcattctgctatttttagcaagaggcctattttgtcagtgttgtctgaatagtatttgccaactcccagactttcagtcacttatttgtttatttatttatttatttggctcttttcttgtatttcccttttccttttctttcctttctttttccatttcctcctcccttcctttgcttacttatttttttccctttaattcccattcactatttccatgactgtcaaatagtaggttgatcctttaaaatattccttttttaaaatttattgtactttaagttctgggatacatgtgcagaacgtgcaggtttgttacataggtatacatgtgccatgtggtttgctgcacccatctacaatatatcttaaaatgaataaaagtggaaacacgcagaagacatggtgtatggggtgagtgggttgccaagtggatggtggcagggtgctccagggtggccagtggggctaaatgctgtgtattccaagcatggcggggttcctgccttcctgtgtggcagactgtggcatcaggtaagagccacttggtgcccaccctggctcctccattgccttgctctcagcccctggcatccagcccacacctggaggttgagctgcacccactgctctgggtctcagccctgtgatcacctcagtagatattctgagcttggctatgcaggcaacactgagccatagtttactattctttcttgcatttctatcagagagtcagcaaaggtagttgacaaagcccaaaggagaatgttgaggggagttgatgaccttgactttttcatacaggatgaagccattgataaatctatgtatgctacaaagtggtcaatatgactggaatcactgaagactgggatattatggaaaggttcatggagcaagtggtttttaaatatctttgagcagaatctgaggaccattattttttaatgacagaacttccactgaatacactagaaaatacagagcatttttgcagaaattatgtttgaattatttaatgtaccaggattctacattgcagttcaggaggtactggccttggcagtatcttggacatctcaacaagtgggtgaatgtatgttaatgagtatagtcattgacaaaggagatggagtcacccatgttctcccagttgtagaaggttatgtaattgggagctgcatcaatcacatcctgattgtaggtgatactgtgtatttcactcaacagctgctaagggagagggaggtaggaatccctcttgagcagtcactggagaccacaaaagccattaaggagaaatactgttacatttgccctgatacagtcaaggaatttgctaagcatgatgtggattcctggaagtggatcaaacaatacacaggtatcaatgtgatcaaccaggagaagttcataatagatgttggttacaaaaggttcctgcaacctgaaatatttttttacccagagtttgccaacccagactttatggaatccatcttgaatgttgttgatgaatacaaaactgtcccattgatgtgcatggtccactgtataagaatgttgttctttcaaggggtttgaccatattcggggatttgaacctcaactacagagagatttgaagagtggtacatgccagattaaaactcagtaaggagctcagtggcaggagaatcaaacctaagtttgcagaggttcaggtggtaatccatcacatgcaccacaatgccttatggtttggaagcttaatgatagcctcaactctggagttatttcaggcctgtcacaccaagaaggactatgaagaatatggccccagcatctgccaccacagccttctctttggagtaatgtcttagtgtctgccttgaaagcatcatttaatagtgtcatgttggggaacaagtgtccttcagaacccagagaagactaccatttctaaatgacatttggtgttgatgtctgagcagcatgcttgcatcacctagtgcatgaggcacagggcagagtcatttcagtaaaagccatttctttatgtgttgactgttgtatgcccactccttcttctctcactccctttcttcatgcttccccagtttccctcctccttttcacttgagcttttttgttgacaaataccattctgaaggaatttaaatgtgactttgaaaattgttaagaggaaaaaaaatttcaaaaatggcccaaaatagttctcccccaggaaataatgcagtggtataaatccttttcccccagcctatttttataaataaaatgttataaacttaaaatacaaaaaaccaataacataacattatttacaggatgcaattaaagcagtgtatagaggaaaatgtatagctttaaaaacagaaagaaaaaataatctaaaattggtaattaaaacttccatcttaagactctagaaaaagatgagtaaaccaagccaaaagtaagtaggatgtatgaaataaaaaggtcacagtggaaaacgataaatacagaacaggataacattaaaaacaaccaaagaaactcaaaattgcttatttcggaaagtcaagaagataaataatatttagttacattgaccaagaaaaaagaaagaagacactaattcccaaaatcaagaatcaaagaaaaatatcatcacagaccctacccttaaaaggatgttaagaaaatagcataataactttaaggcaaaaaattcgacaacttagataaaatagaacaattcctagaaagacacaaattaccaaaactgactcaaggaaaaaggaaaaaaaaaacaaatatcaatatcaagtaaagaaattgcatcagtaatttcaaatcttcctatagagaaaaaatatacttcactggtgaactctatccaactattaagggaggaaataataccaatgttacaaaaactttattaagcaaatagatgaggaaggaaacttcccaatgaactttatttcatttgatatcaatattaccctgatatcaaaacaagacaaagacattacaagaaaacacagctatataccaatatcccttatgaacctagacataaatattcttaaccaaatattagtaaatgtaattgagcaacatatgaaaaggattttataccataatcaaatgaagtttatctcaggaatgtgaggtggttgacttaacatccaaaaatcaatgtaataaactatattaacagaataaaggacaaaaccatatgatcacctcaatagatgcagaaaagcatttgacagaattcaacactcatatatttaaaaaaatctcatcagcttatgaatagaagggaacttcttcaaatgatcaaggcatctaccagaagcctacagccaacatacttaatggtaaaaatgtgcttacctctagattaggaaacatgcaaagatatctgtgtttaccacttctattttttccttgcaatagtcaaggaaaaaagttatggaaaaaagacaactctttttattgttagccttgtatacagaaaatcctaaggaacacacccacacacacacacccacataccacaccccctcccagacttactagaactaagagggtggcttagcaagtttgtagagtatatgatcaatatacaaaaatcggttatatatatagtagcaacaaacagtacaaagatgaaataaagaaaacaattccaatcacaatagcatcaaaaataaatgtcttagtttgttttatgttgttataatagaatacctgagactgtataaagaggtttatttagctcatgtttctccagaccgggaagttcaagaagcatggcaccagtatctgcttagcttctggtgagggctttagtagtgcatcacaacatggcagaagaccaaagaggaagtgggaatgtgccaagaggccaaacacaaggtacaaccttgtacaatgggttgctttataacaatccattctcagggtaactaatctattcccacaggaaccaatccagtttcatgagagcaagaactcactcactatatgaggactgcaccaagctgctcaaaatggcagagcccccatgacccaagcatctcccattaggccctgcctcttaaaggttccaacatgatttttggcagagacacggaaaccatggcattccacccttggaaccccaaactcatgtccctcttacactataaaatgtaattattcaatctcaatggtccccaaagtcttaatgtattccagtaacaattcaaaggtcaaagtccaaagtctcatataagactcaaggcaagttcctcctagctatgagcctgtaaaataataaaaaaaaaaacaacaagttatttacttccaagatacaatggtggaatagtcatatggcagacagtcccattccaaaagggagaaataggccaaaagaagaaagaggtgacaggcctcgagcaagttcaaaagtcagcagggcagacactaaatcttaaaactccagaataattctccactccacgtgctacctcctgggcacagtggggagtttttatccctaaagccttgggcagccccacctccattgctttgttgggcatagccacatggctgctctcactggttggaattggatacctatggcttttccaggctgaggttgtatggtggcaatggctctatagttctggagtcccagtggtggtccacttcatggattcactaggtattgccctggtacagactctttgtggcagctccaaccctacatttctgctcagcattgccctagggaagatacactgcagtggctctggccctgcaacaaatctccacctgagctcccagtcttttcagtacattccttaaaatctaggtggaagccaccatgactacacttctcttgtattctgcacatctgcaaaactagtaccacatggttgtaaacgccatcaaggcttaccacttgcaccctccagagtgctgtcatgagctgtacctgaggctgcttgatccacgactgcgtgccaccaaggtttatggtttgtatcttgtggaatggcagcctgagccatacctgggtatgattgtgccatggctggggtggctgctgagggctgtgccagaatttggggagcaggatctcaaaacagcacagggcagtgatgcatggattctgtctcttaaaaccattccgtcctcctagacctctggaaaggcaacctcaaaaatttctgaaatgtcttcagggcctttaaaaaattgtctcaataattatcaactggctctcttctctcagtgctaatctctttagtattggttgttctgctgcacccttggattcctctcctgaaaatgctctttcattctctaccacatggccaggctattaattttcaaatttttatgcttgcttcccttgtcattttgcatttcactgaatgtagtaagaagtaactacatagctgctctatattttgcttagaaatttcttctgccaggtaccctagttcatcactcttaagtttggccttccacaaaaccttagggcacaaagccttagaaacaacacagccaaatttttgctatggtctaacaaggatgacttggtctccagttcctaataccttgttcctcatttctatctgagatctcattagaatggcctttgctgtccatatttttatcagcattgtggtaatgactacttaaccaatctctaagaaattctaaactttctctcgtctttttgttgtcttctgagccctcattgaaattatccttaatgctctgtttatggcaatacagtctttttctagtctgctccttcaaacttgtccaacttctgcccattacccagttccaatgatgcttctgcatttttgagtatctaaatagcaacatcccactctcagtacaaattttctgtcttagtccgttttgtgttgctataacagaataccggagactgagtaatttataaagaggtatatttggcttgcagttctgcaggctggaaagaatgacactggcatctgcttgggttctggtgaaagctttagtgttgtatcacaatatggtagaacaaggtcaaaggggagtaggcatgtaccaggaggccaagcatgaagcgtgacctcaccgtatagcaactcattctcatggtaactaatccattcctgagacaactaatcccacaagagtgagaactcactcaccagtgtaagaatagtaccaagctgcccacaaaagaaaagctcccaagacccaaacacttcccattaggccccacctcttaagcattccaacatgagttttggtaaagacactcaaactatagcaataataattaggaataaatttaacaaaataagtgcaaaacctttgcactgaaaactaaaaaacatcactcagataaatgcctaaataaatggagagatatatcatgttaatggattagatgactcaatattgttagatgtcaattgatctacaaattaactgcaattcctgccaagagtctagaaagattattggaaaaattgacaagctgattctaaaattatatagaaatacaaaaatacctagaatagccaaaaaaatcttgctaagtaagaatgaagttagagtacttaatactgtcttatttgaaaattcagtgtaaagcagcagtagtcaagacagtgtagaatccacattaagagagatagatagatcaatggaactaagtggagttcagaatccaacccacataaatagtcaattgattttcatcaaagatgctaagacaattcaataggaaaaagatgttctttcaacaaatgattctataataactggttattcatttacaaaaactaaacctagatccttaggtcatatgcaaaaattaactaaaatggatcacagacctaattgtatgagctaaaactataaaacttctaggaaaaaaatataggagaaaatatttatgaccttggactaagcaaaggtttcttagatataatatcaaaaacatattccataaaagaaaaactggtaaattggacttcatcaaaatgatgaaatctttgcttttcaaatatttcttaaataaatgaaaggagaggattgttccaagatggccgaataggaacagctcctgtctgcagctctcagcacaactgacgtagaagacaggtgatttctgcatttccaactgaggtacctggttcatctcactgggactggttggacagtgggtgcagcccacagagggtgagctgaagcagggcagggcatcgcctcatccgggaagcagcacaaggggtcgggggatttccctttcttagccaagggaagccgtgacagacggtacctggaaaatctggacactcccaccctaatactatgcttttccaatggtcttagcaaacggcacaccaggagattatatcccctgcctggctcggtgggtcccacgcccacagagccttgcttactgctagcgcagcagtccgagatggaattgcaaggtggtagcctgggctgggggaggggcgtccaccattgctgaggcttgagtaggtaagcaaagcagctgggaagctcgaactgggtggagctcactgcagctcaacgaggcctggcagcctctgtagacgccacctctgggggcagggtatagctgaataaaagccagcagaaacttctgcagacttaaacgtccctgtctgacagctctgaagagagcagtggttctccaccatggagtctgaactctgagaatgggcagagctcctggtagggactgactgacacctcatatagccgggtgtccctctgatatgaagcttccagaggaaggatcaggcagcaatatttgctgttctgcagcctccaatggtgacacccaggcaaacagggtctggagtggacctccagcaaactccaacagacctgcagctgagggtactgattgttagaaggaaaactaacaaacagaaaggaacagcatcaacaaaaaggacatccacaccaaaaccccatctgtaggtcaccatcatcaaagaccaaaggtagataaaaccacaaagatggggggaaacaagagcagacaagctgaaaattcaaaaaaccagagtgcctcttctcctccaaaggatcggagctcctcgccagcaatggaacaaagctggatggagaatgactttgacgagttgacagaagtaggctttagaaggtcagtaataacaaacttctccgagccaaaggaggatgttcgaacccattgcaaggaagctaaaaaccttgaacaacgattagatgaatggctaactagaataaacaacatagagaagacctttaatgacctgatggagctgaaaaccatggcatgagaactacatgacgcatacacaagcttccatagctgattcgatcaagtggaagaaagggtatcagtgatggaaaatcaaatgaatgaaatgaagtgagaagggaagtttagagaaaaagagtaaaaaaaaacgaacaaagcctccaagaaatacgggactatgtgaaaagaccaaatctaagtttgattggtgtacttgaaagtgatggggagaatggaaccaagttggaaaacactcttcaggatattattcaggagaacttccccaacctagcaaggcaggccaacattcaaattcaggaaatacagaaaacatcacaaagatactcctcgagaagagcaaccccaagacacataattgtcagattcaccaaggttgaaatgaagggaaaaatgttaagggcagccagagagaaaggtcgggttagccacaaagggaagcacatcagactaacagaagatctcttggcagaaaccctacaagccagaagagagtgggtgccaatattcaatattcttaaagaaaagaattttcaactcagaatttcatatccagtcaaactaagcttcataagtgaaggagaaataaaatcctttacagacaagcaaatgctgagagattttgttaccaccaggcctgccttacaagagctcctgaaggaagcactaaacatggaaagtaataaccagtaccagccacacaaaaacatgccaaattataaagaccatcgatcctaggaagaaactgcatgaactaacgagcaaaataaccagctaacatcataatgacaggatcaaattcacacataacaatattaaccttaaatgtaaatgggctaaatgccccaattaaaagacacagactggcaaactggataaagagtcaagacccatcagtgtgctgtattcaggagacccatctcacatgcagagacacacataggctcaaaataaagggatagaggaatatctaccaagaaaatgaaaagcaaaaaatagcaggggttgcaatcctagtctctgataaagcagactttaaaccaacaaagatcaaaagagacaaagaaggccattatatagtggtaaagggatcaatgcaacaagaagatctaactatcctaactatatatgcacccaatacaggagcacccagattcataaagcaagtccttagagacctacaaagagacctagacatccacacaataataatgagagactttaacaccccactgtcaatattagacagatcaatgagacagaaggttaacaaggatttccaggacttgaactcagctctgcaacaagcagacctaatagacatctacagaaccctccaccctaaatcaacagaatgtacattcttctcagcaccacatctcacttattccaaaattgaccacctagtttgaagtaaagcactcctcagcaaatgtaaaagaacagaaatcacaacaaactgtctcccagaccacagtgcaatcaaattagaactcaggaataagaaactcactcaaaaccacagaaatacatggaaattgaacaacctgctcctgaatgactattgggtaaataatgaaatgaaggcagaaataaagatgttctttgaaaccaacgagaacaaagacacaacatatcagaatctctgggacatatttaaagcagtgtgtagagggaaatttatagcactaaataaccacaagagaaaacaggaaagatctaaaatcgacaccctaacatcacaatgaaaagaactagagaagcaagagcacacaaattcaaaatctagcagaaggcaagaaataactaagatcagagcagaactgaaggagatagagacataaaaaacccttcaaaaaatcaatgcatccaggagctgtttttttgaaaagatcaacaaaattgatagaccactagcaaaactaataaagaagaaaagagagaagaatcaaatagatgcaataaaaaatgataaaggggatatcaccactgatcccatggaaatacaaactaccatcagagaatactataaacccctctacacaaataaactagaaaatctagaagaaatggataaattgctggagaaatacaccctcctgagactaaaccaggaagaagttgaatccctgaatagacccattaacaggctctgaaattgaggcaataattaattagcctaccaacaaaaaaaagtccaggaccagatggattcacagctgaattctaccagaggtacaaagaggagctggtaccattccttctgaaactattccaatcaatataaaaacagggaatcctccctaccacattttatgaggccagcatcatcctgataccaaagcctggcagagacacaacaaaaaaaagaattttagaccaatatccctgatgaacatcaatgcaaaaatcctcaataaaatacaggcaaaccgaatccagcagcacatcaaagagcttaaccaccactatcaagtcggcttcatccctgggatgcaagcctgggtcaatatacacaaatcaataaacgtaatccatcacacttcagccttcgagtagctgacaggtgtgccaccatgcccagctaatttttgtatttttagtagagatggggtttcaccatgttgcctaggttagtcttgaactcctgggctcaggtgatctgctcgcctcggcctcccaaagtgctaggattacaggtgtgagccactgtgcctggccaatctatgtaacttttcatggaaggcaaaactataaaaaaagcagatcatttgttacttgggacttgggtaggtgggagggaggatttaatgcaaataagcatgaggaaactttttgagattatgtaagtattcaaaaactgaatttttgtaattgttgtacaactctataaatttaccaaaactcatcaaaatgtgcatttaaaataaataaattttgtggtctgtatattatacctcaaaaaagctgataaaatataaattggaacaaaagtactggaaaaccataagttggagacaaatgagggtgatcaaaattaatgcatccttcaagatgaaacgtgattttaattttaaaattaattttttaattacttgttaattcaagtacacatattaaatttcaagggtaatcgtgaatagaatagaactagaacatacaacttttaaacaaatagaggggaaaaaccttgatcaatctaacagaatgcattggggaaaagtattagagaaataatatggttaacagaaagcacaaaacatgatgacagaaataaatataaatttatcaataaccacaataaacttaaatggtctaaattagttaaagacagacacttgaagactggattaaaaacatgaaaatccaggtatcacctgtaatagttaaaaacatgaagacacaaaattctgaaggtatgagaagagtaaatgataaataaaacaaatattaaccaatatatggctggtatagctattttcatatcaaaaactataagacaaaaaacattctgaggaataaaagtcattatgtaaagacatctatgcaagtaacaattcaaccttaaaatatatgaagcacaaattgacagaattacaaagaaaaatggctaaatcctcaaccttgaagaaacttaaacctctgagtcaatgaaaatcaaaatgtagtaagattatctcagattttaaccaccgtattaaaaaagcttaatttaaaggaaatatatagacttccatatgctcaaattagagaatatatatactttgaagcctgataaagtcttaggagaactgaacctatactagcctatgaatcaaatcacaacaaataaacaaacattataacatgtggcttatactctgtaactaaaatgcaatttataatagaaaaaaatgtaaatttctttcattttcaaactaaaggcataccttaaataatttttcagtcaaagaagacatgaaaacaaaaatcagaagatatttggaagtgaaatactacataacaaaacttgtgagatagagctgaggcagtactgaaagggtaatttatatctttaaatgtttatattgaaaaatagggtgaaaattagttaagcgtccaccttcggaagtttggaaagagaaaaagagattgggcatggtggctcaggcctgtaatcccagcactttgggaggtcaaggcgggcggattacctgaggtcgggagttcaagaccagcttggccaacatggtgaaacccccatctctactgaaaatacaaaaattagctgggtgtggtggcaggtgcctataatcccagctactcaggaggctgaggcagaagaattgcttgagctggggaggcagaggttgcagtgagccgagattgggccactgcattccagcctgggcaacagagcaagactctgtctaaaattgaaaaaaaaaaaaaaaaaaaaaaaatcggagtaaacctaaataaaataaattaaaggaaataaggcaaaaagtagaaatagacattaataaactataaaacaaaaaaacaataggcaagattcacaaaaccaaatgctgattctttgaaaagaataataaaatagacacacttctggtaagattgattaattaaaaagagaaggcataaataagcaatattaggaataaaaaatgaaatgtaacataaaatatgagtgaaaaaataaagtgaatactataaatgactatatgacaacagtctaaaaacataagtgaaatgaacaacttcgttggctactataacttataaacacttagtcaagaagaaatgggacacctgaatattcctgtatctatttttaaaaattcaatcagtaaatactttctcagaaaacacccactagtatgagatactttaatatgaaagttctaccaaacattcaaagaacatataaataaccactatcacatcaaaataatttcagagaatggaaaaagagggaacaccttcaattcattttgtgaggctaacataaatgcaatataaatatttaagatcattataatccaagaaaattggaggccaaactaagcttagatacaaacatctaaaataaaataatagtaaatctagtaatgtattctaaaaaaattctggacccgttgggtacctcaggaatagaagcaaacatttaacagtttgcccaagcagcttttattttattttattatttttaaagagacagggtcttgccctgctgcctgggttggaatattggcatgatcatatagctcacagcatccttgaactcctgggctccagggaccctctgccttagcctcctgagtagctgggactacaggcacacaccacaatgcctagctaattttaaaaaagtttttattttgtagagatgaagtctcactatgttgcccaggctagcctcaaactcttggcttcaaatgattcttccaccttggtgccccaaagtgttgggattacaggcatcagccacggcacctggcctgagcaggttttaataagtcaccccatgtttggagaatttctaacattattaatattactttcccagtgtagaagccaggaactcaagtttttaaacttcctttgtcatgaaggcatagacacatgatgaacacactgctactgacattaatttctgcttttatctgaatagttggtacctccaggaaaaggaggggaatgaggttggaaaatagtacacaggaagcttcaactatatctataatgattatatatacatatatatatatatatatatatttttttttttttttttttttttgaggctggagtgcagtggtgcaatatcggctcactgcaacctccgcctcctggggatcaagcgattctcctgcctcagcctcttgagtagctgggactacaggtgcatgccatgatgtctggctaattttgtattttttagtagagatggggtttcaccatgttggccaggctggtttgaactcccaacctcaggtgatctgcccgcctcagcccccaaagtgctgggattacaggtgtgaactaccacgcctggccagataatgtttaaattagaaggtcacatgcataaatatgatatcttggacattgatgagaccacatagaaaaactatataaaaagaaaagaggaaaaggcccaggtctaagtcctgagtgatatttggtatttagaagttaggaaaagaagaatggaatatggaagacaagaaaggaagaagcagtgagggaagaagaaaaccagttggtgcctcagaattagaaaaaaaagacaagtgtttcaataagagagtgatcattggtgtcaaaagctggaaagatcttgaatacgatgcagacagaaacgttcactggatttggttaatacacttagtcagataaaccccagcaatttcaccagttacggtcgttttcatactccagagatgaaggataacatttactagcctacgtaatattctaggtcttgaatgtagatatcagtattgatttactttgaacttctactttaaaatcaagaaattaagtctcttctgaaattcaaagatattatcatttcttaacagtcatcaatagttttcatgacatctcatttgaagcaataactaatttatattgcattagctaatttaataaatggtttctgaaagactatatgcaaggataggtcccagtcataaagagctaatacctgctttgaaggaacttacaattaatttaataaaaaagacagaaatgttgtacaaattaaaatggcataagtgccaaagtaaaactggaaaatctggaaaaaaatcataggttcttgaaagatgaaatttcaataggcaaagataaggacatggtaagttaagggataggatggacacagatatagcaacgtgaagtcaagagcacattgagaggtaagtaaatttgtccggatgaagtgagatattttggcaggtgagagtggaaagaaaattcataattgaaacatgaagtgtcttgaatgctttgctaaactttaggagtaaaataaacataagaaatgttatgggctgggtgcaatggcttattatctgtaatcccagaactttgggaggccaaggctggaagatggcttgagcccagaagttgaagaccagcctgggaaactcagggcaatgctgtctctacaaaaaattttaaaaattatccagatatggtgacatgtgcctgcagtcccagctactcagtaggctgaggcaggaggatcacttgagcccaggaagtcaaggttgcagtgagttgtgatggtgccactgtactgcagcctgggcaacagagtgagactctgcctccaaaaaaagaaaaaaaaagagagaaatattatggaagtggaattgatagggcttataaacaaactgaataacagcatgaagaaaaaaggccaagtcaaagatgcttatgagctctctaggctgtataactgagacaatattataacttaaaaaaaaaaaaaaaaaaacagaaaaaaaggaagaagaacaagaggagcagagttttctagtgagaagatgaagatacttttgactacactggtgtaagtgaccttaagagaattacaaacaggattctggttaaataatttattattatgcttgtagttgagggtagatattttgttttagctccctggcaaacagaaccttataggtattcaataaatgtttgctgagtaaatgacattttgatgtatctaaattaatgttacttcaggagagcacctaaacaccaatgttgagaacgtttttgggaatactttaattatgaacttttagaacactagtacaatttttttctaacaaccagaaaaatttcttgtccctaataattcttttcaatgtgccattctcagagccccagctgggtgcagtatatggctaagcaattaatatgggacagctagagttttaaaaatatatagtctatgagaagttacaaatttttaaaaacatattctttttttattattatactttaagttttagggtacatgtgcacaatatgcaggttagttacatatgtatacatgtgccatgttgttgtgctgcacccattaactcgtcatttaacattaggtgtatctcctaatgctatccctccccactacacccaccccacaaccatccctggtgtgtgatgttccccttcctgtgtccatgtgttctcactgttcaattcccatctaagagtgagaataagaggtgtttggttttttgtccttgcgatagtttgctgagaatgatggtttccagcttcatccatgtccctacaaacgacatgaactcatcattttttatggctgcatagtattccatggtgtatatgtgccacattttcttaatccagtctatcattgttggacatttggcttggttccaagtctttgctattgtgaatagcgccgcaataaacatacgtgtgcatgtgtctttatagcagcatgatttataatccttaaatgggatctaattaaactaaaaagcttctgcacagcaaaagaaactaccatcagagtgaacaggcaacctacagaatgggagaaaatttttgcaatctactcatctgacaaagggctgatatccagaatctacaatgaactcaaacaaatttataagaaaaaaacaaacaatcccatcaaccagtgggcgaaggatatgaacagacttctcaaaagaagacatttatgcagccaaaagacacatgaaaaaatgctcaatatcactggccatcaaagaaatgcaaatcgaaaccacgatgagataccatctcacaccagttagaatggtgatcattaaaaagtcaggaaacaacaggtgctggagaggatgtggagaaataggaacacttttacactgttggtgggagtgtaaactagttcaaccattatggaagtcagtgtggcgattcctcagggatctagaactagaaataccatttgacccggcaatcccattactgggtatataaccaaaggattaaaaacgtgttcttatttttaggataatactacaaaacttttctaaaataaatgctctaaaactttttatttgctctctagtatttattgatatggttagctttctggtttcttaatttaccgtacatggttatactcattattaaaagctttttaaatatgatgctgtgaaaggtgttacagagagcaactgcataaatagttctacttatgacagggtaaaaaccactgagcaaacatacttaattgaatggatgacttcttggggaataaaaaagcattataatgtaaaactgtaggtgaaaacccttctcaagttcattgatgttagagacaaacgttttcaactcttttcatttcctatttgctctttgccaagattggaatagtaagtagttaacctgattggtgagaacctcatagttattgagccatatcctagaatcagtaggtaggtttcttttgcctcaaaagtgagaaatccattcctctgtctgttttgcattgtttggatgagtaaactctcctcttttcatttgttattctcagtagtaaacacatgtgggtcaggacccctctaaaaggcatccatttctcttctccagcctctagtgaactccagtctgctcatgatagtgtttttgaggcaagtccttcctcatagttaactgcgtactcaaagtctgctctgaaggatcagctttccagacaggaggagacacgatctatggagaagccttatgtttactccatttttccaaggagatcttacttgggggaagcactggccctccactaatggaactatgttcatccccacttggctccttagtgtctgttctctactgactataacccagaaggaatgtggatattattgtatttttaataggctttattttttagagcagttttaggctcacagcaaaattgagcagagattacagagagatctcaaaaatccccgctctctacaacctacagaatgggagaaaatttttgcaatctatccatctgataaaggtctaatatccagagtccacaaggaagttaaacaaatttacaagaaaaaaaacaaacaaccccattaaaaagtgggtaaaggacatgagcagacacttctcgaaagaagacatttatgcagccagcaaacgtatgaaaaaaagctcaacctcactgatcattagagaaatgcaaatcaaaaccacaatgatttaccatcttatgccagtcagaatggtgattattaaaaagtcaaaaaacaacaaatgctggtgatgttcagagaaaaagaaacacttttacactgttggtgggaatttacattagttcaaccattgtagaagacagtgtggcaattcctcaaagatccaggagcagaaataccatttgacccagcaatcccattactgggtatatacccaaaggaatataaatcattctattatgaagacacatgcacatggatgttcactgcagcactattcacaataaaaaagatgtggaatcaacataaatgcccatcaatgatagactgcataaagaaaatgtggtacatataccatggatactatgcagccataaaaaggaatgagatcgtgtcctttgcagggacatggatggagctggaagctgttatcttcagcaaactaatgcagaaacagaaaaccaaataacacatgttttcacttatatgtgggagctgaatgatgagaacacatggggggaacaacacacactggggcttgttgagggggttgagggacggagagcattaggaagaatagctaatggatgctgagcttaatacctaggtgatggattgatctgtgcagcaaaccaccatcgcacatgtttacccatgtaacaaacctgcacatcctgcatatgtaccctggaacttaaaataaaagttgatgaaaaaaaaatcccggctcccacacacttcctctatgaccaacattccacaccagagtggtccatttgttagaattgataaacctatattaacacatcatggtcacccaaagttcagagtttacattaggttccctcttgggtttgtatgttctatggcttttaacaaatgtataatgacatatttccatcattataatatcatacaaaatagtttcactgccctaaaaatcctctgggctctgcctgctcatccctccctcctctcaattcctgacaaccactgatctttttactgtgtccatagttttgcccctgttagaatgtcatatagttggactcgcacagaatgtagctatttcagattggcttctttcacttagaaacatgcatttaagtttactccaagttgtctcattgcttgataggtcatttcttttcagtattgaataatattccactttctagatgtaccacagtttatttattcactcacctaatgaaagacattttgattgcttctgaattttgataattatcaataaggttgccataaacatccatgtttatgtgcaggtttttgtgcggacttaagttttcagctcatttgggtaaatatcaaggagtgtaattgctggattgtatggtaagtctttttatttttgcaagaaactgccaaactatcatccaaaggggctgtacagtttgtacaactcccacctgcaatgaatgaaagttcctgttgctccgtacccttgccaagatttagtggtgtcagtgttttggattatggccatcctaataggtgtgtagtggtctctcactgttgtgttaatttacaattacctaatgacctatcatgttgagcatcttttcataagcttacttgccatctgtatatcttatttcgtgaggttcctgttgcagtgttgtgttcattttttaatctggttgtttgttttctttttggtgaagttttagagttctttttatattttgataacagtctttatcaaatatgtcctttgcaaatattttcttccaatctgttgcttgtcttttcattctcttgaaagtgtattccacagagcatagatttttttcccttctctttcacagaagggaacagcatggaagaacatacattttaatgttaaggaaatcaagtttatctattatttctttcatggagtgtgcctttgatattatacctaaaactcattaccataccaaaggtcatctagattttctatgttaccatctacatttatagatctgtgttttacattcaagtctatgatatgtttcgaggtaattttgtggaaagttttaaggtctatgtatagattcctttttttttttgcatccatgtggaggtccatatgttttgtcatgatgtatagttgaaaagattatgtttgctccattgtattgcctttattcctttgtcaaagatcagttgacaatatttttgtgggtctatttctggactctattctgtttgattgatctctttgtctagtcttttaccaataccacattgtcctgattatcgtagctttacagtaagtcttgaagttgggtaatgtcagttctctgattttgtttctctctttcaatgtcgagttggcttttctgggtcttttgcctgcccaaacaaatttttaaataaatttgttcatatccacaaaataactttcaggaattttgattgggattgcattgaatcaagttaggaagtactgacatctgacaatactagtctttcatgaacataaaatatttctcaatttatttagttcttttatttatttcatcagagttttatagttattactcaaatagatcttgtatatatttttgttagacatatatctaagatgttaatttttgtggtgctaatgtaaatggtgctgtttttaatttcaaattccatttgttcactgtggcacataggaaaacaattgacttttgtatattaatcttgtacctgccatcttactcacttagtagttgttccaggagttttttttacatgattcttttagaatttttaccgatacaatcatcttatctgtaaacaaagacaaatttatttcttccttcctaacctgtataccttttatttactttccttgtcataattcattagttggacttccagtacaatgttgaaaagaagtggtaagaggaggcatccttaccttgttactgatctagaagaaaagcttctagtttttcaccaatgagtacaatgttacctgtaggattttagtagatagtttttatgcagttgaggaagtttccactctattctagcttgctgatagttttttatttttaatcatgattgggcattggattttgtcagatacctttctgcatctactgatatgatcatgtgatttttcttccttagcctgttgatgtgatggattacattacttaatttttgaatgatgaactaatctcatatatctgggataaatcccacttggtcatggtcatggtgtatcctttttatatgctgtttaattcaatttgttaatactttgttaagaatttttgcatctatgtgcatgagagatattggtctgtagatattggttctataatgtttttgccagattttgatattaggaatgctgaccttatagaataaattggaaagtattccttctgcttatgtcttctagaaatagctgagaaaattgtataatttcatccttaaatgttttgtagaatttatcagcgaatccacctgggcccagtacattctgttttggaaagaaacactgattcaatttctttaatagttataggcctattcatattatccacttcctcttctgagttttggcagattgtgtctttcaaggaattggtcctttttatctaggttattgaatttgtgggaataaagttgttcatagtattactttattatccttttaatgcccatgggatctgtagcaatgtcttctcttttatttctgatataagtaatgtgtgtcttctctcatatttttcttagttagtttggctaaaggcttatcaattgtgttgatcttttcaaagaaccaggtttttgtttcattgaatttattgatttcctgtttttaattgtactgatatctactctaaattatattactttttttcttctgcttactttgaactcaattagctcttttctttctagcttcctgaggtggaagcttaatttattcattttagatctttctttttttctattaagaaatattatcaaatgctataagtttccttctactcattgcttttgctgcatcccataaattttgataagtagtattttcattttgttcaaagtacttgtattttttattattttattttattttattgagacagagtctcactctgtcacccacactgaaatacagtggtgtgatcttggctcattatagcctctgcctcctggggtaagcaatcttcccacctcagcctcccaagtagctgagactacaggcatgcgtcaccacactcagctaatttttatatttctttgtagagacagggcttcatcatgttgccaggctggtctcaaactcctgagctcaagtaatctgcctgcctcggcctagcagagtactgggattacaggtgtgagccaacatgtctggctgttcaaagtatttttacctttctcttgagagttctttgatttggtgttatctagaagtgtgttgtttaatctttaagtatttcgggatgttaaagctgtttttctgttactgatttttagttaaaattcattgtggtctgagagcagagattgcatcctttcaaatttattaaggtatgttttatggctcaggatatagtctgtcttggtgaatgttccatattagccggagcagaatttgtattttgctcttttgggatgaagtagtctataaatgtcaattatatccagttgactgatgatactgttgagttcaactatgtctttattgaatttttgcctgctgtctctgtccatttcggatagacaggtgttaaagttccaactagaaaaatgaaagttatctctttctccttatagttttgccagtttttaactcatgtgttctttttttaagaaaaagggtctggctatgttccccaggctggcctcctgggcttaagcaatcctcctattcagcctccagagtagctgggactaaagatgcataccaatgagcctggcttgactcacgtattttaatattcttttgttaggcacaaatacattaaggattgtcatgtctttttgaaaaattaacccttttattattatgtaatgctccactttattcctgataacactcattgctggaagtctgctgtctgaaattaatatagctaatttaactttctttttattagtgttagaatggaatatcattctccatctctttccttaatcaatatgtatcttgtaaaaaacacatagttcggtcttatttttgacccactctagcaatctctgtattttacctagtgtatttagaccattgacatttaaagtgattattgatatatttgggttaatatcaatcatgcttgttcctctttgctattcattgcccttctttgttcctacttttgtcttccattcttttcctgccttttgtggttttaattgagcattttatatgattcaattttctgttagcatatcaattatacttctttataaatttttgtaatggttgcctgagagcttacaacatgcgtttacaactaatacaaatccattttcttttctttttttttttcttccttcttttgcccaggctggagtgcagcggtgtgatctcggctcactgcaacctccgtctcctgggttcaagcaattctcctgcctcagcatcttgagtagctgggattacaggtgcctgccaccatgcccggctaattttttgtatttttagtagagacagggcttcaccatgttggccaggttggtctcaaactcctgacctcaagtgatccacccacctccacctcccaaagtgctgggattacaggtgtgagccactgtgcctggtcaaagtccactttcaaataatactatatggctttataggtagagcaaacactttataataatatttctaattcctccctcccatttcttgtattattgctctcattcatttcccttaaacataagctatagtcataaatacattattgctattattaatttgaacaaattgttatctattagataaattaagaatttaaaaaattttatctttgtgtatttcctttcgaatattcttccttttttacatagatgtgagtttctgatctacatcattttccttctctctgaagaccatcttttaacatctcttgcaagccaagtcaactggcacaaaagttcttcaatttttgtttatctgtgaaagtctttgtttctccttcacttttcaaggacagtttcacaggatacagaattctaaggctggtgttgtttttttttttttctctctctcaacattttaaatatttcatgccactctattcttgcttccatggtttctgatgagaagttggatgtaattcttacctttgctcttttatgggtagttttacctctgtcttctttcaagattttttctttatctttgacttttctgaagtttgaatatgatatggctaggtgtagtctgtttggacatttaccctgtttggtcttttctgggcttccagaatctgtgacttggtgcttgacattcatttgtggaaattcctagtcattatggcttcaattatgtcttctattcctttctgtcttccttttccttttgatattcccatttcatgtatgttacaccttttgtagtgaccccacaattcttggatattctgtttcattgttgttcagtatttttttctctttgcttttcagttttagaagtttctactggcatattctcaagcccggagattctttctcagctttgtccagcctactaataagcccatcaaaggcattcttcatttgttacagtgtttttgatatctggcatctctttcttacaattttcatcctgtttataatactcatctgttcttacatgttttctatttttttccgttagagatcttagcatatttaacataacttttaaattcacagtctgataattccaatataccctccatatatgagtctggttctgatgtttgctccatttctttaaactgtgttttttgccttttaatacacgttgtaaattttagttgaaagataaacatgatgtactgagtaaaaggacctgtggtaagtaagactttagtaatgtggtgataaggtgtgtgtgttgggggtggggagaaaattctatagttctatcactagatctcagtcttttagtaggcctgtgcctctgagctgtgaatgtcaaaaaatgcttttctggtttttttcactcccttagttggtgcaggatggttagaggaggccagagttggatattttccttcaactatgtggaaggctagaggaggctgactagagttgggaacagaacttctccattaaaatcttactatcagtttttatgaagttagcagtcttggaagtttagatcaaaaataacatcccagagacttccagtttccatttctacatgtaaggatattagaagtcatcactctgtcctaaaaacaaataaaaagctgaagaaactgaaaaatcaacaactcttcttagatccatcagatctaagttggttaggctctgataaaaacatgtgtaggttaggctctgataaaaaatttttttttggggggcagactttgtaagaagaacagaatactgtggtatatttcacaatggttaccctcctctttccttgatactttccctctcctcctgctggttggctgcagaaggtaaaacttaaaaaagtgtgggcctctcccatcccataattggggacctcctcgacttttccacacagagctttagccaagttttaaattacaattcaggtttttgtaccctgctcctggttcccaaagaggttttcattcctgtaagttatgattctctgaatctgtctaatcactcctattttttgggcagcagtttgccctgtgactcacttctctgatggatttaagaagaattgttgatttttcagtttcttcagctttttatttgtttttaggacagagtgatgacttctaatctccttacgtgtagaactggaaactggaagtctctgggatattatttttgaaccttaaatttccaagactgctaacttcataaaactgataataaaattttaatggagaagttctgtccccaagattacttaaaaatcatagttggacatacaagaaaactttaattcatttaaagaaaaaaagcttcataaaaatatattagcatttttgttaaaagtaggctgaaaagaaacaaaaaggaataatatcttaagctctaaatctactgtcctagactatccatttatttgggatgaagcaagccattccccaaatgaggtatgcaaacagtatgatattaaatgtgatgagactgatttctgtgtgcatttgagagtttagatttcttatttaaatttaacttgtacacatgtggtattggtgaattaactattatttatagaaaaacatgttgttctatttccttttattatccaaactctatgcagttttaagaaattattttgttgtttcattctgcttacacatggttgtacattacttattccatgatgcggcagagtgggattactaacagtggcatgttctaagcatacccagagattgagattctatactttgtgtataaaggaaacagtgtgaatgtagggagtgtgttgagagagagggacaaacagagagagattgatttcaaaaaagagagtgcaagaatatgcacccctaaatagaaacacagaaaatctccttttcctataaatgtctccaaaactgcaaaatcaaaaatgaaagaaaacaaagggggaaatgagttatatctaaacctgcagttttagttctgatgttctagaactcctcaattagttcctgagcaaactgtagtccacactcagtgaataattttggtaaataatacatttccctctcttccacagaccctggccctactcctaataactgctttgtagaaatggcctactaaatagaccaagtcatgggaacatatgtatatttacaaaggagtccaatcacttacactggcagatgaggactattcaagttcacagaaaactttgattcaaggccatcaatatactgacgtaaattaaaaagcaacctttactaatgaaaaaaatcaatgaataaaatttgcttcaaaagtttaaagttagcaagcagcaaataagaaaataaaaatttaaaacttcaattacttgtgcttcatcatttttaatcaattttttgttctctatagggaacaaaattctatatacttctggaagccaaaatctctttctctcataggtttaatcaaacagaatatttagaaaaacatacacaagaaaatctctttataagtatttgctgacaacaacactatgctttaaaattgtagtgggaaagcaagtgttatacaactttttacaaggttgctgctgttttaaaacttagggcccaattttaataagaaacataattatttccaaaattataatgttctttctagctaacttaaaactaaatgtcaaagtaggttttaaataaaatcctttaatcaatgatgtttctaatcccaaaaatttaacataaaaaagtatgacaaatattaaaacatacacctcctaggcaatattttgtttttgtttttatctttgaaagattcaagaaaatatttcctctttgttcacatattgcttgtaacaaagctgatcatctgatctggagtatattgattaagtagtgtctttgttgtctcatgttttaatatttatcaaacatatttctcatcttctcttcatttacattttttgtttcacataccatttgtaataattacattcaatactcctcttagaggacaagaaatgtatgtctccttttttgtctgtggttttatttcttctgtatctgataagacagttttagtttcttcctgtgcagtattattaggatcaatgagactctgtagtaaaacaagaaaatctttaaggaaccatactttctgtataattttatgaatgaaataaaccaccaaattttagaattaaatttatattattactgtcaatgcgaggaatcacagatacaaaagaagattcatgctccatatcagtagctgtttggggatgtaacagcagtgtattttgcaaggtaccttgattgaaccttttatagacttgggtccccactattttcaatcatttgtgtatactgaataaaggtgcctacagtttgggcacaataattaaaagtgtccatcctctgtatacatcccaaagattattcaccaaaacttttgtgaaatgaaaatacaactcaattagaaaggaggtgaaatataattttacttggattcatctcatttgataaatttatataactgaaagaaaaatgagaaaaacataggtcaagccttcggaaattcaagcatgcttccactaatatttatagataacatattaaatagtgcaagggtataccttaatctcccaggccttttaatggtagcctgattatgaaactgctgattttgaaaaaaaggaatctttggtttgtgagaatattgagaaacttcttccaatgtaaaaaacaaaacataaacaatgataacaacaacaaaacaccagagtagagttaactctgcagtagaaatctccaaatttgccttatgattgtcatgggtgggtgggtgtgggggtgtgtgtgccagcaatttgagtgacttgataatactttgagtgagtgaaagagggaacatcttatcatcacaggaaacaataaaaaggctagagtgcatggacacattgaggaagggaattttacatgtaatgactaaggagacagagatatcaaggcagctgatggttaaaaatgaattatgtagctctttaagatcaaagttcttcaaatctgatcataattaacctattggagttctggtatagaggcaggctttttctgaaaattctgttactatataaaagggataaagacacaatggtgaatttttattaaggtgggtgaaaggtcatgtagagtaaaaccatattattttaagttttattattttagaatttgtaataaactgatgtagactaagatgacttcttcacagataattagaatcaatggtgaatatttaaaatatttttaaaaatgactttttgacccttaagaactgtagaaatctctattttaaaaaaatacgaaatttacaattctaattatgagcaattattactaagtaaaactagatcaacaaaaggtctaacgacttgctctatatatctataaaaataaaaaacttgggtctcttcaaaacacacagcacaacattttaattaatctagacttatctttacctctgttagtttaagttactgagttttccctgaatgtggtgagaaataataagcgacatttcttcttattcctaaaatctgtgctctttagctccaaaatgctctatagtcacacctttccatttgtttcattatttctgctcatttcctaggacccattacaactagctattttaaaatttaccacttttcatttttaaccagatatataaaagaaacctatctaataagtaaattaggaataaattttaagatcaggttgattttatatcatatattacagtatacttttaagtttttacctgaggagttgtagatgtttggaagttttcatcctccaaatgttcattttttgattctgtggtatgcatgctaagatttaaaagaaaaatactttaaaagaagaaacaagactataaatccatatgaaaacaaacatggttaagtgggattaattttttaaaggattttttgttctaaagttgtatcacagtcaagtcagatatctttatagtcaacatagatccaaatattcatctttaacattattaaccaaagccatatgcataagttttaaaaaccattatcatacagaaatgtaatatttctcaacagttcataatgctggcccatatcatagaatcatgtatcagaaaatgcagaaatttattttatgcactgaactggtgtgtttgagttaatatccactgttgatttaatctatcttctgtcatgctcttacataaaacactccagaaaaattttaaatgaaatatgaccaactacattaatacctacatctataagttactgatacatactatctttttatgtggcccatttgaaggatctgtaggtccaacatttaaatatatctataaagttttattttgaagaagaataaactagatgaataaaataataattacttataacttttattttaaagtatctgttgtttctacctcctctgtaatctttgctagcttcaaatataagtagggtaacttttcttaaaaatatcttctctcaatttttgagttgttgttaagaacaaaactaaagatttcaagttttaatttttagatagtcttattaccatatcctgtagtgcttcaagtatctatacttttctaaaaggaaaacaattttaataatgaaaattgttaacgaaaaggaacattaacagttgagtagctaccatatgctagctgctttacatctattgtcttaccataatgaagtaaaatattactgcataaaatcctataaagaatcataactgaatttataacattattaaagcaaaaaataacctttaaaaattttgatcagaaacttagatctaaattcctttaaagtgtagttccattttgattgaagtgactgtcaaaataactatcttgtcattagaatgatgtattagtccattttcatgcagctatgaagagatacctgagtctgggtaatttataaaggaaagaggttgaattgactcacagttccacatggctggggaggccacaggaaacttaaaatcatactggaggggacctcttcacagggtggcagaagagagaatgagtgcaagtaggggaaatgccagacacttataaaaccattagatcttctgagactaactcacaagatccagctacctataccttgtcccacccatgacatgtggggattgttataactcaaggtgagatttgggtggggacagagacaaatcatatcattctgccccggcccctcccaaatctcatgtcctcacacttcagaacacaattatgcctttccaacagtcccccaaagtcttaactaattccagcattatctcaaaagcctaagtccaaagtcttgtctgagacaaggcaagtcgcttctgcctatgagcctataaaatcgaaaggaagttggttacttcctaggtacaatgagggtactgggagaaattggccaaaacaaagaggctacagaccccatgcaagtccgaaatccaatagggcaatcagtaaaccttaaagttccataatgatctccttttactccatgtggcacatccaggtcacgctgatgcaagaggtgggctcccatggccttgggcagctccgcccctgtggctctgcagagttacagtcccactctctggtgctttcacaggctggcattgagggtctgctgcttttccaggcacatggtgcaagctgctggtggatctaccattctggggtctggaggatggtggctctcttctcacagctcctccaggtagtgccccagtggggactctgtgtgggggctccaaccccacatttttcctttgcactgccctagcagaggttctccatgagggctctgccactggagtaaacttctgcctggatatccaggcatttctatataccctctgaaatctaggtggaggttcccaaagctcagttcctgagttctgtgcacctgtcggcctaacaccacgtgtaagctgccaagccttggggcttgcaccctctgaagcaatgccagagctgtacctggcctcctttagacatagctggagctgaagcagctgggatgcagggcaccatgtctcaaggctgcatagagcagggtgaccctgggcctggcccacaaagccatttttccctcctaggtctccaggcctgtgatgggaggggctgccacaaaggtctctgaaaatgccctggagacattttccccattgtcttggtgattaacatttgactcctcattacttatgcaaatttctgcagcaggcttgaaattctacccccttccccagaaaatgtttttttttctattgcatcatcaggctgcaatttttccaaacttctatgctctgcttcctcttgaacactttgccacttagaaatttcttctgccagatatcctaaattatcactctcaagttcaaagttctacagatctctggggcagaggcaaaatgccaccagtctctttgctaaagcatagcaagagtgacctttactccaattcccaacaagttcctcatctccatctcaaaccacctcagcctacacttcattgtccatatcaccatcagcattttggtcaaagccattcaacaagtctctatgaagttccacactttcccacatcttcctctcttctgagccctccaacctgttccaacctcagcttgttacccagttccaaagtcgcttccacatttctgggtatctttataacagcagcccactctgtggtgccagtttacattagtcctttttcacgctactacaaagaaatacccgagactgggtaatttataaaggaaagaggtttaatggactcacagttccacatggctggggaggcctcaggaaacttacaatcatggcagagggcagctcttcacaaggcagcaggaaagagaatgagtgaaagcaggggaaatgccagacaattataaaatcatcagatctcatgacgtgatcacatcagatcactcattatcatgagaacagcatggggaaaccacccccatgatccagttacctcctcattgttccacccctgacacatggggattattacaattcaaggtgaaatttgggtggggacacagaatcaaaccatatcaaatgactaccttgtcataagctgttagattatgaggtaattggtaagaataagggaggtaggtgaatcacctaagttgtgtcatgttctgaatagacagactgggagttagagccattaaaaagtttgagctgaagtgcacataaattttgaggagaggacacaaaattaatttacacacttaataatttttgaatgcctactcttctggcctctgaaggcaaagcagccaatcaaaacaaaataaaacagaaatataggcttctgttctcatggatcttatactcttgttaggtggaaggggaagattataaaaaacattttcagtactgcagaaaataaatgaggatcatattatagagatcaaggtgacatttgaactgtgtcctaaatgaggagaagctgtgagtcataagtaagcagatggacaaggagcaggcaaacataacaccaagaatcatacaaatggagacatcaagcgactaggcagcatattttaagatatgtaactataatgattaggatagcagggcttggaacccaggcaagcagactatgtattagaacttcaaaacctaagtaaggggtctgaataatagatgcacaggttaatagctataagagaagctttatactgagtcaagcaatatttgtgactggcagtcactcaataccctctttatatatctgccaagagtggaattggtaggtggtatgcctaaaagcaaggactttgagttgagaaagaaatgtattcaactcttctcttatcttttcataactgtgggaagtgatttatctccactggcctcaatttccttatctgaaaaaatatataataatgcttagtttattggttatcataataattaaattataatagctaatgccagttgaactatattaagcacttaacatgaatcatcttcctcaattctctcaacaactctatgaggtatttaatactattatccccattttatagatgttcaaactatggatgcaggaaagttaagtaatttaactttcaatatggtcatataactagcaagtggggagctggaatttaaatgaagtactctttaatattactcagatctttgtcaactttagtattgtctcttttttcttttaactgttgtggtgacattgcattatgaatttaaattgcatttctataatgagcattttttcatatatttactggccatttgaatatcttctttagtaaagtgttcaaatctcttgtccatttttttgttgtactggatcccattttcatactgatttgttggagttctttttaggtattaaaaatgtaaatcttttattggatatataaagagccaatatcatctcccactctgtgtcttgcttttttacgctgataataccttttttaaaagatactttaatttggcccaatttattctttcctttctttatccttagagcttttgttgtttaagaaatctttgccaacccatgtaggagaatgtttattctcctatatattcttccacaaacattattgttttgcttttcacataggaaaggaacaacaacaggtctatggtctatgagccatctggaattgaatttcatatatgggatgtgaggaagagatcaaagtttatttttcccatatcaatatctaattgactcagcacaatttattaaaaatatcatcctctatacattgtattgcaatgccacttttttttgtaaatcaggtaatcacacatatatgaatttattttcatattctatcctgttccactggcccatttgtctatccttaggctaacattatgctagtgcttgtatttttttttctgagatagggtcttcctctgtcacccaggctggagtgcagtgacacaataatagctcactacagcctcaatctcctgggctcaagtgatcctcccacctcagcctcctaagtagctgggactacagccacaagccatcatgtccagcaatttttttttttttaaatttttagtagagtcgaagactcactatattgctcaggctggtctcaaactcctgagctcaagcaatccttttgtctcagcctcccatagtgctgacaggcatgagccattgtgtctggccagtataacagatattgacatctggtgttggtgtacattctccacttttgttgttcttcagaattggattgactttttgatcctttgtatttccacatacattttaggaccaagttgtcaatttacacacacacagctggaattttgactgaagttacattgaatctatagattaatttggggagaactgacatcttaacaatattgagtcttccaatctttgaacactgtatattcctccatttatttagattttcttgatcttaataattttttgtgttttcaatgtacagaacagtatgtctttcattaggcttatttttaggtattttatgttttttggatggttataaaaattataactttaaaaattcattatttgtttcttgctggcatacagaaatatgaataattttcattcatttcactttgtatcaggccttgataaattcacttaattctaatagtctgtagatttgtttggattttctaagtacatacatacacagtcagcaaatataagttttatttcttcctctctaaattttatgtatttttctccctttttctttgtttttctggctttaacctgctgttacagttgttctaaatcattgctaaccttggtattgtctgtcttcagaatttgttttaatatagatctgttggcgataaattccttatttctttgcctgaaaaatatctatacttaaccttcacttttgaaagtgattcttattagatataggttagagtttattttctttaagtactttaaagatgttccactgtattctggctcccatagtttctgttaaaaatttaactgtcattcttgctatgattcctttgataataataatatcttttttactttggctgatactaatcacaattattttaagcaattttcctgtggtaaaatatgcataaaatttaccattttaaccactttaaagtatatagttccaggggcattatgtatatttgcattgttaagcaaccatcaccaccatccatctccagaactttttcattatcttgacctgaaactgtgtatgtattaattaaacaataacttcccattctcccctcctccaatccctgatagccaccattctcctttctgtctctatgaatgtgaatattctaggtactttatatgattcaagtcatacaatatttgcccttttttgtcttgcttattgcacttatcatgccttcaaaattcatccaaaatttattcaaaattctgtacatgttgtagcatgtacagaatttccttcctttttaaaggctgaataatatgcatttatatgtatatatcacattttgtttatccattcatctactgatagaccttttggctattgtgaataatgctgctatgaaaataggtgtaccaatatctgtttgaatccctgatttcaattctatttggtatatacctggaaatggaattgatggatcatatggtaattctatgtttaatttttggaggaaccatcatcatatggttttttttttttcacagcaggtacatcattttatattgacatcaacgatgcacaatgattccagtttctccacatgcaggcaaacacttgttattttctgttttttggtaatagccatcccaataggtgtgaatggtatctactgtagttttcatttccacttccctaatgattaatgaggttgagtatcttttcatgtgcttactatttgcatatatcttttttggagaaatgtctcttcaagtcctttgtccatttttattcttatttttttgagacaaggtctcattatgtcacccaggctggagtgcagtggcacaaacatagatcgtgcagccttgaactcctgggctcaagggatcctctgcctcagcctcccaagtggtaggactactggtgcacacgtccacacccagcaatttatttttttgtatagccagggtcttgctgtgtagcccaggctggtctcaaactcccagcctcaaagtgctgggattatgggcatgagctattgtacccagcatctttgcccattttaaaattgggatgtttgtttttttccgttgctgagttgtaggagttctttatatactgtaggtattaatatcttattagtaatatgcaagtattttctgtaagttgccttgtcactctgttgatagtgtcctttgttgcacataagttttaaatgttaatgtagtccaatttatctgtttttccttttgttgcctgtacttttggcatcatagccgagaagtaaactgccaaatccaatatcatgaagctttccttctatattttcctttaagagttttaatatttttagtttttataatcgtagttattgtaacctctttaactcaaaaatctggatcccttttgagtctgtttcccttttcaattttctatcttggcttaaggtcatataacattgtctaatactatggttcacaatttttattgaaagtttgacattgtgtacaaattgtacagtctccagatgataacttcttttggaaagaaatatgtggagtagggggagtgaaaaaatcactttaaccaaatcagagattgagctcagttgatagctttgtaatgctcagttttatttcaatttgtccttgttcctcaagtatagtcctttagggattttgccctaggtgatttccttgataaattatggcagtgtcacttgattcctcccatatcaggcattgtattattctgttttcacacttgttctataaagaactgcccaagactgagtaatttaaaaaggaaagaggtttaattgactcacaattcaacatggctgaggaggcttcaggaaacttacaatcaagtggaaggtgaaggagaagcaaggaccctcttcacatggtggcagaagagagaagtgcaagcaggggaaaatgccagatgcttataaaaccatcagatctcatgagaacgcattcactgtcttgagaataggacgagggaaactgcccccttgatccagtcaccttcctcccttgacacatggaaattacaggtctcttcctctacacatggagattacaatatgagatgagatttgggtggagacacagaaccaaaccatactgttctgcccttgccctcccaaatcgcatgtcctttatacatttcaacatcaatcatgccttcccaacagtcccccaaagtcttaactcattccagcattaactcaaaagtacaagtccaaagtctcatctgaggcaaggcaagttttcaaaaccaatcatgccttcacaacaatcccccaaagtcttaattcattccagcattaactcaaaagtccacagaccaatgtctcatctgaaacaaggcaagttccttccacctatgattctgtaaaatcaagagcaagttagttacttccaagatacaatgagggtacaggcattgggtaaatattcctgttctagatgggagaaattggtcaaaacaaaggggctatgggccccacgtaagtctaaaatccagtgggggcagtcattaaaccttaaagctccaaaataatctcctttgactccatgtctcacatccagggcatgctgatgtaaagggtagactcccatggcctagggcagctctgcctctgtggcttggcagggtatagctccatgcctggctgctttcacagctggcattgagtgtctgccgacattacaggggcatggtgcaagctgtcaatggatctaccattctggtgtctggagaatgatggtcctcttctcacagctccactaggtagtgccccattggggaccctctgtgagggggtccaaccctacatttcctttccacactgccctagctagaggttcttcttgaggctccacccctgtaccaaacttctgcctgggcatccagtcatttccatacatcttctgaaatctaggtggaggtttgcaaagctcaattcttgacttctgtgcacccatgggcccaacaccacgtgtaagccaccagggcttggggtttcaccctcttgaagcaacaacctgagctgtacattggcccctgttagccatggctgggatgcagggaaccaagtcctgagagtgcacaaagcagcaaggccctgggcctggcccacaaaaccactttctcctcctaggcttccagacctgttatgggaggggctgccatgaagatctctgatattttccccattctcctcattacttacgcaaatgtctgcaggcagcttgaacttctcccccaaaaatggatttttcttttctattacatggtcaggccacaaaatttgcaaactcttatggtctgtcacctcttgaacgctttgctgcttagaaatttctcctgccagataccctaaatcatctctcttgagtatgaagttccacagacctctagggcaggggcaaaatgccagcagtctctttgctaaagcacagaagagtgatctttggtccagttccaataagctcccatctccatttgagaccacctcagcctgaaattcagtgtccatatcaccatccagcattttgatcaaaaccattcaacaagtctccaggaagttccaaactttctcacatactcctctattcttctgagccctccaaactgttcccacctctacctgttacccagttccaaagtcacttccacattttcaagtatctttatagcagtaccccactcttcacagtaccaattttctgtattagtcccattttcacactgctataaagaactgcccaacattaggtaatttataaacaaaagaggtttaactgactcacagttctgcatggcttaggaggccacagaaaacttacaatcatggtggaaggcaaaggaggagcacggaccttcttcacatggtggcaggagagagaagtgcaagaagggaacaggccaaatgcttataaaattatcagatctcatgagaattcactgactatcttgaggacagcatggggaaaactgcttctatgatccaatcacctctctccctcaacatgtgggcttacaggtctctccctcaacacgtggggattccaattcaagatgagatttgggtggggacacaggcccaaaccatatcaggcataccttaccatttcctaacttggtttatttctactgtccatactttcctatattggaagagctgaattaacatcttcaatgttacataactataaataaaggagttggagcccatcaggcagtctgactccagagcccatactcttaaaactaaactgcttataatgtgacaagtattctgtgcaagacacagactaaagctctcataagaatttataggctaacatttagaaaatgctgtaataacttaaatctataaaagattaaatgatctaccaagaaaagagaaaaaaatccaacaactatatgattttttgacttttccattttagaaaatgaactagtacgagtaacttctttaggaagtaaaaaagagtcttaagaaaaacttaaaaatagaaaataaaggatgaataagtcacagaaggctaaaatggtttagaaatagcccattggaaatcaattacaaagctgttcagacccttggggattatgccaataatgctattccattgcctctgagcagccctatccatggtccttaactctcgagtgctttcactgaacactctggaacttctgccagatgattatcaaactgtattatattctcaacctcttttcaaagcattctctcaaattctgtgccctatatgaaaccaagcccttcctttaaggaggacactgcttcccctatagtcctctcacataacagcagtttattcactaacattccttctgacaccctactgctatttctaaaacttcttatataaaaaagaaacaaaatccttgcttttttaaagcttgtataatttgacaatatcaccttcctccccttctactcactgttacttactcaccttattttgatccctttccattattcaccaaagatgttggtgcttgacccccatatttgtaatcttttcatcttacacacttggataattcatctactatcttgtttcttcagttctttacttcctttctaataaaggaaagaccacactaaaaccttctatcatctgaaatgctctattatcgataatcatgatttcaagcatctacatctctgaatactacttcatcttctttcagttctcttgttcagttgtattcacttcatcccctccaattattcttcactttcatcaggatgtgcagtgtaatgaaccctgtaactcaaacttttgccctcttccttctttacctgtttttgtattcaatacctgtgatccatcatcctcaaaatactgctataaatatcttaaactatcttgaaatatctttgttgcttcattgttgcacatttgtagaaacacctcaatctagggatgctgctgccctacttccactgatgcccctccccagctgacacacatgcacccttttgcactgctgaggcagctggcatgtgtgagcatgcaaagatcctcttgccactaccccagtgaagcactccaatgggggtaattccccattggagtactgtggcagtggactaggaataccttggctcctgcagcacagcaggttcctaaccttgaggggccagagaacagagctaggggcctggtttcagccccccagagctacagcacacagctgaggagagctcagctgagccttgaccccttaaaatcttccagaaatgaagccagccaactgaacccaccttataccacaaccaaacccccaagggcatcaaagaagataaaagcaaaaagccccatctataggacaacaacttaaatgttgaaggaacatgagcccacacagatgagaaataaccagcacaagaactctggcaactcaagatgcccgagtatcttcttacctccatatgaatgtagttgttcctcagcaatgattcttaaccaggctgaaatgacagacatataattcagaatatggatagaaatgaacattgacattcaggagaaagttgaaccccaatgcaaggattctaaggaatacaataaaatgatataggaacttaaaaatgaaatggccatttaagagagaaccaaactgatctgatagaactaagaaactcactacaagaatttcataatacaaccacaagtattaacagcagaatagaccaagctcaggaaataatctcagagcttgaagaccatttctttgaaacaactgtcagacaaaaataaagaaaaaagaacaaaaagaataaacacctctgagaaatatgggattatgtaaagagaacaaatctacaactcatctatgtcccagaaagagagggagaaagagtaagtaatgtggaaaacatatttgaggatatcatccatgaaaatttccccaatcttgctagagatgccaatattcaaattcaagaaatgcagagaacccttgtgagatactatacacaatgaccatccccaaaacacaaagcaatcagattctccaaggtcgaaatgaaagaaaaaagcattaaaggcagctagagaaaagaggcaggtcatctacaaatggaaccccattaggctaagagtggacctttcagcagaaactctacaagccagaaaagattgaggggcctatattcagcattcttaaagaaaagaaatttcaaccaagaatttcttatctagttaaaagaggcttcataagcagaggagaaataagatcctttcagacaaacaaatgctaagggaatttgttaccaccagatgtgccttacaagaggtcctgaagggagtgctaaacatagaaattaaagactgttaccagccaccacaaaaacacacttaaatacatagaccattgacactataaagtagaaactacacaatcaaatcttcataataaacagctagcaacatgatgacagaattaaatttgcatatatcaaagtatcaactttgaatgtaaatgagccaaatgccccaattaaaaggcacagaatggcaagttggataaagaagcaagacccaacaatatactgtcttcaaaagactcatctcacatgcaatgataactataagctcaaagtaaaggaatagagaaaaatctaccaagcaaattaaaaaaaaaaaaaaaaccagaaaaaagcaggggttactgttctaatttcagacaaaacagactttaaacaaacagtgatgaaaaaagatgacaaagaaggacattacataatggtaaagggttcagttcaacaagaagacctaactaccctaaatatatatatgaacccaccacagaagcaaacagattcataaaataagttcttaaagacctatgaagaaacttagataaccacatacaagcagtgggaagtttaaacatcccattgacagtactagacagatcactgaggcagaaaactgacaaagatatttgggacctgcactcaacacttgatcaatgaacctaacagacttttacacaacttgccaccccaaaacaatagaatatacattattctcatctgcacatggcacatactgtaaattggccacatgatcagccataaaacaattctcagcaaatttaaaaaaactgaaccacactcttagaccacagtgcagtaacaatagaaataaatactaaaaagaactctcaaaaccatagagttacatagaaattaagcaacctgtttcctgaatgacttttgggtaaacaataaaattaagtcagaaattaagaaattctttgaaactattgagaacaaagatacaatataacagaatctctgagacagggctaaagcatgctaagagaaaagtttatagcactaaatgcccccatataaaagttagaaagatctcaaattaacaacctatccttacggctagaagaaatagaaaaacaagagcaaaccaaccccaaggttagcagaagaaaagaaataaccaaaattacacctgaactgaatgaaattgggacatgacaagcaatacaaaaagatcaaggaatccaggagttggttttttgaaagaataaataagattatttaaagaataaataagattataaataagaacaaataagattatttgaaagaataaataagaccacagctagactaacaaagaaaaaaagagagaacatcccaataaacacaattggaaatgacaaagggacattaccccagagaaatacaaaaaatcctcagactattatgaacacctctatgcaaacaaattagaataactacaagaaatgggtaaatttctggaaacgtacaacctcccaagattgaaccaggaagaaattaaaatcctgaacagacaaataatgaattctgaaattgaatcagtaataaaaaggttaccaactagaaaaagcccaggaccagaatgattcacagccaaattctgccagatatataacgaagacctggtagcattcctactgaaaatattccaaaaaattgaagaggaagaactccccaagtcattctatgaggatagcatcatcctgatacccaaacctggcagagacacaataaaaaagaaaaaggccaatatccttgatgaacactgatgcaaaaatcctcagcaaaatactagcaaatggaattcagcagcacatgaaaaagctaatccatcacgatcaagtagactttatccctggcatgcaaagttggttcaacatatgtaccaataattgtgattcatcacataattagaactaaaccccaaaaccatataataatctcgatacagaaatggcttttaataaaattcagcataacttcatgttaaaagccttcaacaaataggcatgaaggaatatatcttaaaataatgtcgtttatgacaaacccatagccaacatcacactgaacaggcaaaagctggaagtattacccttgaaaaccagagcaagtcgaggatgccctctttcaacactcctattcaacataatactggaagttctagccagaacaatcaggcaggagaaagaaagaaaaggcatccaagtaggaagagaggaagtcaaacaatctctgtctgtagatgatatgattctacacctagaaaaccccatagtctctgcccaaaagctcctagatataaaaaactacagaaaattttcaggatacaaaatcaatgtaccaaaatcagtagcatttctatacaccaacaagtccaagctgtgagccaaatcaagaacaagattccatatacaacagccacaaaaagaaaataccctaggaatacagctaaccagggaagtgaaggatctctacaatgagaattacaaaacactgctgaaagaaatcagatatgacacaaagggaaaaacatttcatgctacagtatcttggcatcactataaatgcataacagccttgaaatcagaaatatactggttgtatgatcttgggtaatttacaatctcttgtcatcttttttttttttttttttttttctggagagatgggttctcactctgtctgtcacccaggctggagtgcggtggtgtgatcatggctcactgcagtctccaactccccagctcaagtgatcctcccacctcagcctcccaagtagctgggactacagacatgtcatgtctggttaattttttgtagggacggggtctccctatgttgcccaggctggtcttgaactcctgggctcaagtgatcctcctgccttggcctcccaaatctcatcagcttttattgggcatagtactatctgtttttcttcatattcacagctagggaaagcagaatcacatttgaggacagacacccaaatatgagttgactggataagtttattagaaattatggcctgctttttgtactaacaaaaataagacttcttactggtttatattccagtgtcttacatataaatgatcagctcagtttaaaaaatttttatgctttacttatttcaataagcttcttaaaatccttttcggaatgaggtagatataagtacatacataaacacacatatatacatatcttgctattatgggaattaagtgagatgtttgtacaacttatagcaaaagctatggtatttaaaacttattagaagtctgtactgctgttatattgctaggctttgctttcaaaatagtgaaaaattttgatggatttagaagttccattttcaccttggttttttagaatgtctgtttgattatatattaataatggacacagtgtggtattgtaaaaagaactgggcaatctaagttctctgtttttcatttgctacttttttttttttttttgacagaatctcaccgcccaggatggagtgcagtggtgcgatctgggttcactgcaacctccgcctcccgagtagctgggactaccgacgtgagtcactgtgtccgtctagtttttttattttttggaagagatggggtttcaccatggtggccagaatggtctaaaactcctgatctcaagtggtccgccagcctcagccttccaaagtgctgggattacaggcatgagacatcgcacctgaccctgatacatcatattgagtaaatttcttgtcatttcatctctctgctcgattccaaacctataaagtgacgtagggagtgaggatcttagatgatctaagggctttaacagtttcttttttttttttttttttttgagacggagtctcgctctgtagcccaggcgggagtgcagtggcgcaatctcgactcacggcaacctccgcctcccgggttcaagcgattctcctgcctcagtctcccgagcagctgggactacgggcgcgtgccaccacgtctggctaattttttgtatttttagtagagacgggtttcaccgtgttagccaggatggttttgatctcctgacctcgtgatccgcccaccttggcctcccaaagtactgggattacaggtgtgagccactgcgcctggccaggctttaacagttttaagtctatgattctattatctgaggggcataccaagaaataggctgaaagaatagcaatacgtacttcttgggaacttcatttcttaaataccatgtatgtgcatatgtatcacttaatataaacaacttgtctttccttggtgtgtccatacacaatactatgggtttatgcttttggagcaatgttgtgcaacagtgacatctagtgactacatatcacagatcattcagcaaaactttatggccaacttgtactcttctaaatgtggatgatttactttgtagcccagctaaatacttttaaataattcctcacctctctcctctaaagaaaggtatgccaattaaatttgacaacagcattaataattggctaaataagaactgaaatttcctttaaaaatcataatgtatatggaattcagtataaattattctaaatgagactgcagctcttttccttccactgagagtggcaaagctgggattttcaattccagtgtgtttaaatatagtctattctcttatctactatgcattgctgacatgtagtaggcatttaacacatacttattcaattaatgttaggtaaaacatatgcatcaacagttgtgagtatgtattgctttggaatctttggaactattgctgcctttcaaacaaagaactcttcttgaggtcagataaaagattaacacaattataaacaaccacagtatacatctttctgaacaaatgaatttgagacctacatgcatgcataacagaatactctttataaaaggcattcaaactaggtcagtattttttttaagataatgactacctagtattattatttaatcaggacaatacaaatctgggctaaacttctactactataattcaaattgactgtcattgttaaaattcctaatagtatttaggatttgatctcattagtcagatagtaccttgattttaaaccgttttcgggtgcctagatcttgttgccacaataaagtgacacggtgtctgtcttaggtcattttgtatgctgtaacagaataccacagattggataatttataatgaaaaaaatttctttctcatagttctggaggctgagaagttcaagatcaaggcaccccagcatcttgagagggccttcttgttccattctctggaggggagggagtctatgtcctcctcacatggcagaaggtataagggtaagggacgcaaatgggtggcagaacttgtccttttataatgaaattaacctcacccatgtgggcacagccctcaaggcctaataacctcttaaaggtcccacctcttgatactgttacaatcaacatgagttttggaggggacaaacattcaaaccatagtagtgtcttagtctatttgtgttgctttaacaaaatcctcaagattgggtaatttataaataacaaaaatttattttgtcacagttctggaggctggaaaatccaagatcaaagtgctgacagatttggcatctggtaaaagctcagatctctgcttccaaaatggtgccttgaatgctgcatcttctggaggaaataaatgctgtatctttacatgttggaagagacagaagggcgaaaaggggctagctagctccctccacttattttataagggcattaatccatttatgagggcagagccctcatgacctagtcacctcctaaaggccccagctcttaatactgttgcattggggattaagtttcaacatgaaattggagggacacaaacattcaaaccatagcattttgccccttcccccacaacaaattcatgtctttctcacatataaaacacacttgttccatcccagtagctccaaaagtcttaactgtttccgataccaactcaaaagtccagagtccagagtctcatctaaatcagatatgggtgagactcaaggtttgattcatcctgaggcaaattgctctccagctgtaagcctatgatatcaagcaagttatatcattctaaaatacaatagtgggacagacagaggaaagatagatattcccttttcaaaagggaggaaatagaaaaggagaaaggggtaataagttccaagtaagtcccaaacccagcaaggcaaacaacattaaatcttgagacttgagaataatcttctttgactccatgtcctgccttctgcatacaatggggaaggggttgagcccccatgtctcctgggagccttgcctgcatggctttagggggagcagaccatgcaccagttctcacatgttggcatcacatgcctgtcgctctcccaggcaggaattgcacactggtatctctagtggcctacagtcttggtggtggctctgcccccatagctccactaggcattgctcttatgggggctctctgcggtatccctgactccacagctcttgtaggcactgccctagtggtgactctctgtgctgacctcacacctctggcagttctgtgcctgggccccaaggttctctgtgacctcctttgaaatctatgcggagatagccatgactacagacttagcaccacatgggcaccaccaaggtttactgtttatactctctgacactgcacctgggcctgcttgagccacagctggtgtggctaaggaatgctgagccacatgtgtggagcagaaagttgacgtggccctaggcagcaagccctgagttcccatggacaccctgggcccctcccttgaaactgttctgccctgaaggccctggcactctgagcctgtgataagagtggtagcctcaaagatctctgaaataccttcagggccactcctccactgacttgatgaataacatctggcttccttccatccatactaatctgcttatcaaacatgcacttggccatattcttggtattctctcctgaactcagtctttacaacctggttaggctgaaaaatttccaattctttaagttctgcttcctttttgattataaattccatcttgaattaatttttctctttttgtccagtatcataaacagtcaagagaagcatgtagcaccctcagcattttgtttaggtatttcttcccctaaatatcctatttcattgctcacaggttctgcctttcacaaagcattaggacacaggtggaattcagccaagttctttgctactttataacaaggatgacctttcctccagtttctagtaagacattctttatttccactgaagaactcatcagaatggtctttactctccacatttctaccagccttctgatcatgattaacttagataatctctaagaacatgaaggctctttatacagctctcctcgtcttctgaaccttcatcagaattgcccttaatgctctgttcatggtaatctagactttttctaggaggcacttcacaactgttctagcttttattcactactagctacaaagctgcttttacaataataggcatttgttataggaacactccacttcttagtaacaatttcttagcccattcctgctgctatgccaaaatacttgagactgagtaatctataaataacagaaacctactttctcacaattctggaggctgggaaatccaagattaaggttcagtcaggttcagtgtctggtgaggtctctgcttccaaaagggtgccttgaacattgtattctctgaagggaatgaacattgtgtcctcacatggtggaaggcatgtaaaggcaaaaaagtcctagctagctgtccccaggcctcttgtaaggacttttataatacattcatgagggcagatccctcatgacctaaccatttcctaaaggcctcacctcttaatattgttgcattggagattaagtttcagcatgaattttggaagagacataaacagtcaaaccatagcataaaccattccaggcatgttttatattcttttctttctcttagcaccaaacacaatggtttttctcaactatagacaaagctaccaaaaacttacccagaatccaaggtttgctatacatggaatcaaactgtctcaccagctttctttctggttctttcttttgacccaacatttcagtcaaactgttaactgcactccatgcctttatttggttggaacatcttcccactgaacctctttgtaaatatccattgattattctaaataaagcttcctgcaatgcacactacataaactggatgtgtttttccccttttgaattctcacatcattttgttatttgctctaccatccttacctctctggtgtcctttctttgtctttgttagtggtttctttcccctattcatcctttaaatattgggcttcctcagaattcttctctatgccctattctcttctcactctatatacatttctcaacatctattctactattatggctacaattctaactaatatgctgaggaatttgaactagaaaagctctcaagattctatttagtatatctaattacttattgaatatctctacttgtcttacaagcatcttaagttagtatatgcacaaactcaagatctttccccaccaaagttattccttctctggataatttcctatctcagagaatgaagccaccatcgacctagttgctcaaaacagaaactgagaagtcattctttctcgctgcttttctttatctgctaaaatcaagtgaattactaaatcatgttaagacaagttactgaatgtttaaaaattttattcatttctttccagataaattgtcactagtccagtccaggccataagcatttccccacctaaacaccgtaatggctttccaacttttccccacatccagtcttgttcctcctcaatgtaattttcacaatgcagaacaatattcttaaatgtaagcttgattatggcaacaaccttcttaatattcctcaatgacttcccatagaagaaaaatgttaaaactccttacattcagcttatagggtcctttgaataaggctctaaccttgaccctgcctaccttctcattcatcacttgacactctaaactttagccatactaaatttttgttcttcaaacttgccatgtctcacatctccaaaactttatgcattctgtacgctgccttccaacaccaacactcttgcttttcatccagctaacgcttcatcaatttagaagtcatttcttccagaagatttcctgacgctaccttcaacatgcatccttatcatggcatccaatgcttatcacagcatccaccccactattttaatccttgtttaactgtcatcatttttaaatttgacaaatattcattgagagcccattatattacagatactgtattctcctctgtatacagaatgtggtaaatatagagtattgtagaagcacgtttaggatgtgagagaagtccaagaaatgctttttagtgacttgtgttcccatctatttccctactaaattaaaccagagacagtttcataatcatttctgagttatttgaattgcctaacatagtatatagtagataaatattttataccatcaattattggattttaaatacatactaaatattctttgcattgtaagaggccaccagccagccaatactttctacccagcaactttttctttgatatcactttgcatacaatagagtgtaaaaagcaaagagacaaactaatatagtggaaaatatgggacttagagtcagaacactgtgattaataattctgccacttactaggtatatgtccttcgtcaagacccttaacctctctgagtctcaatttcctcatctgaaaaaggccattaggagaatgaaatgagataaagagaaaataaaagcataaaatgtaagaggttatccaaaatgatgtctattattattattgttattaaagtcaatgcagatcaagtctccttatgactggttatcccagctctgtaaggctacaagattttcaaagttcattcttcatcttccctttaccatccaagagataatcttttgtactttaataaacacatattgatggaaatggttaaaaatcacaaagaaaaacaagcccaaaattgaataagtatacattaatgtatgaaagggacaagacaaaagtaccagcctatgacagtttataatttgaatgtatggaccaaaaaaaaaaaaaaaaaaatcaggccacaattttttttaatgttgaccagaagggtaggtaggtggcacaaaagagtaatgctgtgaactgtttcacagtaaaatggtaacccattgacctagaaagtcaagatatctgggctcaaatactaatttagctactaattcaaccactaatacccaggtggtctacccacccaacactctagtctttcagttccttgatctccttagctcctattgtctttttctttcactgtatctcagccactcactcacagggccacaaatctcaaatggccactcaactttgcccagctgtgctattattctgattgctttccatcctccaaatgactattttgtatcttatcttctccccttaaacctcctacccaaatattcctcctcactctttactaatcttgcgtcataccttatcttcattgagaaaaagtatcagtatcaggccgaaggtctcacctctgaccactgaatctacccatctatctgcatctctacccatacttgctgtctttcttcttaccagaaattatacgttcatgtggttgggtgcggtggctcacacctgtaatcccagcactgtgggaggccgaggcaggtgaatcacctgaggtcaggagttcaagaccagcctggccatggtaaaaccctatctctaccaaaaatacaaaaaattagccaggcatggtgtgttggtgtgcgcctgtaatcccagctactcaggaagctgaggcaggagaatcgcttgaacccgggaggcagaggttgcagtgagctgagattgctccattgcactgtagcctggacaacaagagccaaactctgtctcaaaaaaaaaaaaaaaaaaaggaaagtatatgtttatatgttcatgttcctacctaaggccaatacttctatatattccctggattccataccctctcattttctcaaagacttcactcctaaaatatacacactctctcttataccatcatttccacccccctctattggattattctcagtctaaatatgcttaagtgtccttatctttaagaacccttctttgaccatacatatttctctattacctccatttcttggctctctttcatagtaaaacatcttgagatgtctatagtactacgtcaatttctgcccagccagcagtactatgtcaatttcttgacaccacattttctctttattgtactagtcaaggcatataactacttaatgtttccaaaacccaatgcacagatctctttattttatttgacttctaagcatgattcagtactgttggccatgttttgtagtcttggctttttttttttttttttttaattgagatggggtttctccatgttggtcaggctggtctggaactcccgtcctcaggtgatccacccaccttagcctcccaaagtactgggattacaggcatgagccaccatgcccggccagtctcggcttttatgtcactgcactcttcagattttcttcctacttcattggctattcttccatctcttttgttggcttcttttcctctgctttacactagtcactgcaatgttatcggtgagcacacttgccctaggtagttttccatatgctggtgactcccaactttgcatctttggttccttgcactctgcacagagctgaagcctcaaattacctttgatttctaataagaatgtaaaaattaaggtaagcaaaataaaactcccccctcccaccgccctggctgctcctttttcttccttagtcttttccatttggtaaatggcacaatcatccacacaagctcaagacaaaaatttaggggctagaggtgactcctttttcatcacctctatattcaaaacatcacaaaatctgtaggctctgcccccaaaatagagctcacatacatctacttctctgctattttatcccaaacttgtcattcctctttggatttctgcaattatcttctgctatagatcttgctccccacccagtatgattcagtcatcacataataggcagaacaaacctttttacaatgtaaatcagatcctatcactccctccaactcactactggtttctctttacactttaaataaattccaaacttattccatgggtagatttccatggcctattcaaagccttacatgatttggcccctacctatccctccaagctcatcctgtaccactttctctacattttagcttcagtggtcttgatgatgttcctggaaggagccaagttctttccttccttagggctcttgcaattggagttgcctttacctgtagtgcgctgatcccaaatatttccatggttggtttttaaaaatatcactaagcaatcaatctaaactaacccctcccccagtcttaaggaagacctttacagttttacttcttcactgtgcttactattatccaaaattccttgctcatatagtttacctattttctatcttacactcactagaatttaaacttcataagaacagcgatcttgctagtctttcttaccattgtattcacaatgcctaaaacaacgcctgacaaagtaggatattctttaaaaaatacttaatgaatgcctttccctaagcaagtcacttgacttctctacttaactcacactggtgagtttactactgctagactaagctctggatccaggaaaaacaaaagtggctaaggtatggcttcttcagaagctcatccattcattccctcaaaaaatatttattgaacatatattacactatgttccaggtactattcaatctcagtgtttagtaaacaccacagtaacatgggatttggttaaccaacagaagtgtttaaacaggatgagtacaaaaataagtacaaaatgagaagtactataaaaacgatactttatatgttacaactatagcacccacctatttccttgtgtctagtaattggcaggaccttatgacaagagccaactgaaaaacagcagtataaattctggtactctaaaagcccagacttcaccactgtgcaatatatccacacaacaaaactgaacttgtactaactaaatctgtatagaattttaaaaagtaagttaaaaaaaattctggtactcacaggggacaatacctatgaatgcccttttcataggcacacagtgactaaaatatttggggcatgaattctctaggggtgacaataataagtgtcatttttcatgcttctgttgcacacataattatatttatctctaaggaaaatcagagagtggggtgtggcctccctcagtgccacctgggccagttgtctccccacatcaccaaatctgttatttcacaggctctaggacacccatagagggggagtgagggacctggtatggtcccgtgaagagctcttgtaacactactgattgatgtgacagacacagtatgtgtgcaactttcctttttccttcaaaagcactggtctaaagcagggatccccaacccctgggcagcagacaggtacaggtttgtggcctattaggaacaggccacacagcaggtgagcagggctagaggattatgcctgagctccagctcctgtcagatgagcaaaggcattagattctcataggagcacagacctgattatgaactgcgcatgtgagggatctaaattgcgccttctcaagagaatctaatgcctgatgatctgagatagaagagtgtcatcccatcttgccccccaccccaaactgtcttccatgaaactgatccctggtgccaaaaaggttggggactgctggaagtgcttgtcccctgggttaaagccaagaggagtaaacaggattaaggggcgtggatgtgggtgggtgggggaagagagctttctcaggatcggcaaccaatcccagaatctccagtcgcaggagcatgtatgtgaaggtttatttgcagggatccaccgtttgtaaaatagtacacgcttaataaaattaattttgaggtcaatcttaactgacagatctcttctttcttactggcgagtatttgtaaaataagaaaaacaggaggaaaagagaacaaacaagagagatgtgggatgacggagtaaggaaaggagtcacggagaggagagacaatgtctgtggctgttccctcagcgtctgggagaagagcccaagaatcccattgaactgagggggaggaaaggccctcctgcggcctaccgcaaggaaacgatcgcggcagacccgggactagcgccaaagggcttggaagggcggcgttaagaaaaatgggccgtacctacaacttctttcgcagccctcgctggcccgggagcggcccaggagcccagtgaccgttgcgtaagccacgcgccacccaggtgggcagggtggtgacgcgaaagcccggatagacttccgcgcaggggcggggcggggc

SEQ ID NO: 2116 - DNA, 134705 bp, Homo sapiens; identical to SEQ ID NO: 2115

SEQ ID NO: 2117 - DNA, 134705 bp, Homo sapiens; identical to SEQ ID NO: 2115

SEQ ID NO: 2118 - DNA, 23838 bp, Homo sapiens
caggccgaggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacaggtaatcctcccccatcagccagtccccatccttgcacgttcgccaagcgggggaaggaggcgtaaaaatcctagggccaaggggcgggacggagctcggcgcctggcacgtgatccccgcgcgcagaggaaggtgggcgcgcgccgacgcagctgcctggggaacgcctgtgaggcagtctccgggtgcttgatgccccagggtcttttgtcctcggagttgtctccggtgtcattccgtggcaagataccaggtttttgcagagaaggtgctgagttgggaacaggccagtctctttcatctcctgtcctgctcatcgctctctgtagcgtacttgtttattttaaagcgggctaagtcgtcgttatctaaggcctcatgtaacaggcagccccagctaccggctgggttgtaccctcagcatgtgggtgggagtgtgtgggagagaaatatagacttacacgtaacacgtatatgaccgttttatttagtaacgaaattaggagataacctccattccctcaggttagaattgacctatcataggtggcatttgaggtcatctccgtttctacggtcccggggcccgctgcggtaacttaagttggaagaaagataccttacccaagaaagtattcgaaggccggtatgaggagtgaaatcttagaaaatgaaatttagtgaatatatgtaacgttctatacttaaggaccctcacttaacccacacaactcatgaggatttcacatctaaaggatgaaaatctccagaatgcagtcaacacttgggagattgtgttgagttatgagcatttcattgtaagggggatatttctaaacggaactcagaccgagtaggatggtgaaggaatcagcaagtattgaactcctatgtcctaggttatcagggagtgcaaacatgaattaagataattctgaggtaaatagggttgcttcgccgggaacgttctaaagatctgtagtacctgacctaaaatacagcaatcgcacagctgtctggtagaagaaaaataagatttgtgtagactaaaatatagaactgataacaaattaaccaaattagtgaaggttattgggaggtgaatttcagtctaaggaagatttttttttaaattaaagaatgctttccccaaacaaatgtggtgcttcagtgatagcccctctcaaagatgaaaaaaacaaacaaaaagactctggtggtgggtggtcgatagatttagaagggataaactagatgacaaattctcttccaaatctagagattcattgaattatggtcagacagacgctctgttgagtggattgtgagattttaatattttttaaatattaagagttttagtagaaaacatgcaattgaatagaaagcatggtaacaataataaacattaaaaaggaacattaaacatcagaagcaatgcaaaagtaaaataaaatgaaaaacgtttcacatcaagtgtttataaacatcagatcttttgatcctaccagtttactctgacagaattgcagcaattccataaaattttggctttccccacttcttttacttaagtactttacatattttaatataatcctcattttttccctaacaactaaatacttattttagttttaacatcacaatgggcctaaccattcattcccttacaactggaaattagaaatgtttctattttttaaaattcattatgtaatagttcattggcaagtaagcaaataccagttgtcatatttctcccttttggatgtcttcacttaaatagcaataccaggccaaaacggtatgatcatattgtgacttttgtacccttttgtcattttgacatttgtaccttcttactaatttgcataagttaactgttgaggaatttttaacagtcaagaaaggaaaatgtccaatgaattacctatgttttttccagatggtggctgcatttgtattagtttcgattctctgtaaatcaagtataattgaagaaaattagaaagtatgaaactagatttaatggctagattttagaagtatgctttcttttcttgaggatccctagtgtcaacaaatatttaattcctattaaagacattaagaaaactcaaccaaaaccttttctctcttaagaatatatagtaacttcctcttaaaagttgttaaatatttaatatgaagactgattctcagaaataatgaccattctgagaagtattttaataacatacatttaacttaagtcccattacagtgtggctatagttaatagttctcattttattgctggtttatttaggaaacatgaacatgcttgtaataactggtttatgaaaaacatgagatagccctttttggattggacaaaacaattgcagggtttattttggagtactatagaagaaaaatttcagtggctattttccactctcggtctcccattctgaatagattgtaacagttaatgacatttggctttcttaaatgagttacttgtagaatccataatgtacacttttgttaaaataaaaacctggaagacaactttttagcaattgtttaaaatgtctaggagaccaaaaaatatttccattttcttctatgaaaattagagcaaaaaacaatacagttcacattattattgcctacatttccttccctatttaaatctagctgttttttaaagctattgactctcttatgatgactctgcattcttagaaaccacatggagatctttaatgaccatatactaaatacaggcagttctcacctatcagaaacaacttaactatctttgtttatgtcacattttcaagagtgaggcgttcaagataaattactgtgattatctaatttatgtttaacttaggtttttgttttgttttgttttttgagagggagtctcttttgcccacactggagtgcagtgtcggctcactgcaacctctgcctcctgggttcaagcgatgcttatgcctcagcctcctaagtagccgggactacaggcatgtgccaccatgcctggctaattttttgtatttttagtagagacggagtttcaccatgttggccagtctggtcttgaactcctgacctcaggtaatccgtctgcctcggccgcccaaagtgctgggattacaggtgtgagccactgcgcccagccctaccttaggttttaagtggtaatagtaaactcatgcaatgaaaatattttatcttttctacagttaagaaatagaaataatttctgtgtttagctacatatgataaatgagaaaatatgttataaaataaccagcaaccaagctgccagtattatttttatggtatcataagatgatatggctatattatatgtagatgtttgaaaatttgaaatggaaaaattctgttctagttctgtggaatgtaattcctcattaagatcggagtttgtctatgtcatttttatgtcattttatgtcatttttagctattattaaaaaatgttttaataatagtatttatatgtcataaggaataggtgtcatagctagcctgtgtcactatatataataaaaggttaaacctaattttgtttcccaaagaagatacttcattttgacaatgtctaaactttcagaaaatttatgctaaaattggtagctaccgtattattccgttttcatactgctataaagaactacgcaagactgggtaatttataaaggaaagaggtttaatccactcacagttcagcatggctggggaggccttaggaaacgtacaatcatggcggaaggcgaaggggaaacaaggcaccttcttcacatcatggcaggaagaagtgccgagcaaaggaggaagagccccttataaaaccatcagatatcatgagaactcactcactatcaccagaacagcatgggggataccacacccataatccaattacctccacctggtctttcccttggcacgagattatggggattataattcaagatgagatttcagtggggacacaaagcctgaccaaatcagctattcaagttgctttgaaattttcttttctgactagattttggttttcttttgtgagaaagggtttcactctgttgcccaggctggagtgcaggtggcatgatctctacccactcattgcagccttgacttcacaagctcaagccatcttcccacctcaacctcttgagtagctggtactacaggtgcacgctaccacacctggctcatttttttgtatcttattttagagacggggttttgccatgttgcccaggctggtcttgagctcctgagcttaagctatccactcacctcagcctcccaaagtgctgaaattataggtgtgagccactgtgagtggcctagattttgtttctctgatggtgctggttctttcattcttcctttttggtcctgttatttatcttaatagtgggatacgtggaaggctgaggcaagagaattgcttgagtcgtggcactacattccagcctaggcagcagagcgaaaccgtctcaaaaaaaaaaaaaaaaaaaagggatgtaaaagtcaatatgaatattaggtccttgctcagtattgagctcaataagaagatgaacaactcacatttaaaaattggcaaaacaggccaggtacggtgtggctcatgcctttaatcccaccgctttggaaggctgaggcaggcagatcacttgaggttgggagtacgaaactagcctggccaacatggtgaaaccccgtctctactaaaaatgcaaaaattagccgggtgtggtagtgcacacttgtattctcagctactcaggaggccaaggcaggagaatcgcttgaacccaggaggcagaggtcacagtaagctgagatcgtgccactgcactccagcctgggcaacagagtaagactctgtcttcaaaaaaaaaaaaaaaattggcaaaacagaaaaatgaacaaaatcttatcctttgcagcaatatggatgcagctggagaccattatcctaaggagattaacacagaaacagaaaaccaaataacacatattcttacaactgggagctaaacattgtgtattcatggacatgaagatggcaacagtagacactgggaactgctaaaggggagggaggcaggaggtcaagggttgaagactattgggtactatcctcactacctaggtgggaggatcagccatatcccaaacctcagcatcacacaatatacccatatgacaaacctgcacatttacctcctcaacctaaaataaaagtcgaaattatattaaaatattttaaaaaggaaatttgggcacacacaaagggagaacaccatgtgaagatggaggcagagattggggtgatagacctacaagctaagggacaccacagcttctccctcagatcctccagaaagaatcaaccatgctgacaccttgattttggacttctcgccactagaactgtgagtgaatacgtttctgttgttttaagctaaaaaagaaaacgaaaatgcaagcacgaacacattgttctctgcagtttagggaatcctagtagagactactgctcacatttgttctctcttctctgctttaatggccactaccttagttttatctcaaactattttcttccagaccatttccatggattttcaacaggttgtcttgccttgtcttcttccactagccctctctgctattcctgtggccctctaatccatcttccatctgataccagagtgacttcataggtgaacaatttcctagttaggctaatattcaaatatttcagtggtttcctattatgcacaggttagattcttacttacctgttgaatatcagagtttgtcatcatacggcacctgctcagttctacagctccctttcattaaattctaacaatactatggtgcttagtttcccagacacttaatgcatgtcatatctccgtacctttgcctatgcagcttcctctgcatggaatgaagctcctcctcccatattcccatgaacttctgtactcttcatctttcagaaacctatttaagtatcaaaacctgtacagtttttgctcatgccagtaaaaagtgaataacttgtacctctgcgttgcttctgtattattgctgatagtacacagtattatgatcgtcttttataggtctgtcttccatactaaatggcaagctcctttctaacagggagtgtgttttataatttttgtatcttcagtacctgtcccaccacctgatacatgtgagtgaggtattacaattttagaaggtgctgaaagtttttttcttaaatattttaagtagtcttcctgtattttaacttacactgtcattattcataagccatgaacaaagacaagtaagtacagaccttgtaggaattatctcaaatgccagtttattggagtacaaactcaattaggctaaaacttactgaggtcttggtttatgtaagtctctgttaaagggtagggagttagggattttttgtttagttggggaggagacaaatatttacctaactgtatagttttaaggcagaatgcattaatagtttgaattgtgttctgtagtttttactgagtgggttcctacttcattcgtttctcccagcaatcctatgaagttagaagactctttacttttctttgtgccttgaaaattctgcgctcaagtgcttgagctcctggcttctcattcgttaggtctctgcttaaaggttcttttttcagaaaccttccctgaccccttacctaaaattgcagccaccctactgctttgccccaggttagtttttctcttatgtcatcctttatttcctttataacagttactatagtctgtgatcatcttgtttatttgttcacttgtttatagtctctgtcctctgaaatatataccctatgagagaagggaccttatctattagcctgtatccccacatagtgcaatttgtggagtgtggtaggtactaagtaaatattgttgaacaaatgagcttacagttgttattcctgctttacagacaaaagaaacctggttccaagtatatgaaaatctggatttataccacagataaactgaattagttgtttactgaagtcctgttatgtgcaaattactaagcactggttacatagatataaataagacagctactgtatttgcatttagcacagtatctctacatagtaggtgtattagtctgttttcacactgctataaaggtaactactcaagaggccaggtgctgtggctcatgcctgtaatcccagtactttgagaggccaaggtgggcagatcatgaggtcaggagatcgagaccatcctggtcaacatggtgaaaccccatctgtactaaaaatacaaaaaaattagctgggtttggtgatgcacacctgtaatcccagctactcaggaggctgaggcaggagaatcacttgaacccctgaggtggagattgcagtgagccaagatcatgccactgcactccagcgtggtgacagagtaagactccatctggaaaaaaaaaaaagataatacccaagaatgggtaatttataaaggaaagaggtttagttgactcacagttctgcatggctaggtaggccttaggaaacttacggtcatggtagaagggagcgcagacaccttcttcacaaggaggctggagagagaagagtgaggagtgaaagggcaagagccccttataaaaccagatctcatgcgaacagcatggggaaaaccactcccatgatccaatcacctcccaccagtttcctccctcaacatgtggaaattatggggattataagaggtgagatttgggtggggacacagagccaagccatattattccacccctggctcctcccaaatttcacattcattttgcatttcaaaatcaatcatgccttcccaacagtcctccagagtcttaattcatttcatcattaactcaaaagtccacagtacagagtctcatctgaaacaaggcaagtcccttccacctatgagccagtaaaataaaacataagttagttccttttaagatacaatggcagtacaggcactgggtaaatacacctattccaaatgggcaaaattggccaaaacagaagggccacagggcccatgcaagtctgaaatccagtggggcagtcattaaatcataaagctccaaaatgttctccttgaccccatgtcacatctggagaacactgatgccaggggtaggctcccatggccttgggcagctccttcaagggctggcatcgagtgcctgcggcttttccagatgcatggtgcaagctgttgttagatataccattctggggtctggagcaggtagccgccttctcatggctctgccaggcagtgacacagtggggactctgtgtgagggctccaaccccacatttcccctttgcactgccctagcagaggttctccatgaaggctccacccctgcagtagacttctgcctggacatccaggtgtttccatacatcctttgaaatctagggtgaagttcccaaacctcaattctagacttctatgcacccacaggcccaacaccacatggaagccaccaaggcttgtggcttgctccctctgaagcagtggctcaagctgtatgttggccccttttagccatggctgggacacagggcatcaagtcccaatactgcacaaagcagcaaagccctgggcctggcccacaaaaccattttttccttctaggcctctgggcctgtgatggaagggcctgctgtgaagacctctgacatgtcctggagacattttccccattgtcttggcaattaatatttggctccttgttacttatgcaaatttctgcagccagcttgaatttctccccagaaaatgggtttttcttttttttgggggggcggggggaaggagggggacagagtctcacactgtcacccaagctggagtgcagtgacacaatctcagcttgctgcaacctccgcctcctgggttcaagtgattctcctgcctcagcctcccgagtagaactacaggtgtgcaccaccatgcccagctaattttgtatttttagtagagacggggtttcaccatgttggccaggacggtctcgatgtcttgacctcatgatccgcctgcctcagcctcccaaagtgctaggattacaggcatgagccaccagcacccagctgggtttttcttttctgttgcatcatcagactgcaaattttccaaacttttatgctctgcttcccttttaaacctaagttccgatttcaggtcatctctctctcaagtttcatcagtctcttgggcaggggcaaaatgccaccagtctgtttgctaaagcatagcaagagtgacctttgctccatttcccagtaagttcctcatctccagctgagaccacgtcagcctggatgttattgtccatatcactgtcagcattttggtcaaaaccattcaataagtctctaggaagttccagactttcccacatcttactgtcttctgagccctccaaagtgttccaacctctgccagttacccagttccaaaattgcttccacattttcaggtatctttatagcagtacccaactctctgttgtagcaatttactgtattagctttcacactgctataaaagaaataaaaacataaaataaaaatactaccccaaactgggtaatttataaaagaaataagtttaattgactcacagttacgcatgactagggaggcctcaggaaacttacaattatggtggaaggggcacctttttcacgaggcaggagaaaagagtgaagagcaaagcaggaagagcccattttaaaaccagatctcatgagaactcactatcaggagaacagcatgggggagattgccttgatgatttaatcaccaaccaccaggttcctcccttgacgtggggattatgggattacaatttgagatgagatttggatggggacacagagccaaaccatattagtagatacttaataattatatagtaaatatttaatttttatagtaataattatatagtaaaaatttgtttaacaatgagaaattgatttattctttcagaaaatgtttagtaagcacttaataaaaatcagaagggggggattgattgggaaagtactacaagagcaaactttctggggcaatggaaatgtattttgtcttaggtggtgtttataggtccatatagttacaaaactcatcaaactgagcgcttcacaaacacaaagcttggccaggtgcggtggctaatgcctgtaatctcagcactttgggaggctgaggcaggcagatgggagtttgagaccagcctggccaacatggtgaaaccccatctctactaaaaatataaaaattagcagggcgttttggcaggcacctgtaatcctagtgactcagaaggctgaggcaggagaatcgcttgaacccgggaggcagaggttgcagtgagccaagatcatgccactgcactccagcttgggcgacagagcgagactccatctcaaaaacaaacaaacaaaaagcacaaagctcaataaactgaactgtaaattaaacacttcaaacaaaagtaagttaaataaattgagccagacgttatatagacactggggacacagatgatcagacaaataaggtccctgcccttgtatctctctttttcttttattttttattttttttatttttttgagatagagtctcttctctgtctcccaggctggagtgcagtggtgagatcttacctcactgccacctccacttccgggatttaagtgattctcctgcctcagcctcctgagtagctgggattacaggcgtgtgccaccatgcccagctaattttctgtatttttagtagagttgggatttcaccatgttggccaggctggtcacgaactcctgacctcaagtgatctgcccacctcagcctcccttagtgctggaattacaggcgtaagccaccacgcccagcccccttgtatctcttatattgtgagtggggaacatgataggtagatgcagccattaaaatttatgtttccaactgatattaaggagttggggaaataatataataatctgacataccattaagtgaaaaatgcaatatagccttattttttaagcatttacagcctatgtatttacataccaaaaaagagatacatttaccaaataaatacataaatgttattttttataatcctaagacaaaaataaataatatgctgaataaaatacattattttatacaaaaatttgcttggtgtggtggcgcacgtccataatcccagctatttgggtggcggaggcacaagaatcacttgaacctgggaggcagaggttgcagtgagccaagatcatgccactgcactccagcctgggtgacagagtgagactatctcattaaaaaaaaaaaatattttaaattattttatttggtcaggcacggtggctcacgcctgtaatcccagcactttgagaggccaaggtgggtggatcacctgaggtcaggagcttgagaccaacctgaccaacacggtgaaaccccatctctactaaaatacaaaaattagctgggtgtggtggcgtgcgcctataatcccagctactcgggaggtcactgaggcacgagaatcgcttgaacccgggcagtggagattgcagtgagctaacacgacacacactccagcctgggaaacagagcgagacgctgtctcaaaaaaaaaaaaaaaaatttttttttgcacattatttacagttagtaatattttcctttcaaagtatctaaaatatctgtaatagctgaacatatatcaaacagatctatagagactagcacatgtaaaattttttttaagtttcttgtttgattcttctgtatttcatctttcttcatataaaatcagccttaattgacagagaaatattctatgtactcattcatatgtgggaactaaaaaagttgatctcatggagatagtcaaatggtagttaccagaggccaggaagggtagggagggagagaatgaagagaggttggttaatgggcactatagtacggttatatagaaaaagttctagtattcaatagcataatagggtgactattgttatcagtaattttagtgtatatttcaaaataggagaggaaatttggaatgttctcaatataaataaatgataaatgaggtgacgaatatcccagttacactgagttgatcattgcacatcatatgcatgtatgcatgtagcaaaatatcacttgtaccccataaatatgtacagttattatgtatcagtacaaaaacagcctgaataaatgtacttacagtcatttgaattgagcttttcaagctgtattgctttcatgtataaagtttttcagtagttaaactgtagttggttatctttaaaaagtagattatgttaagactttggtaagttattactttgttgtaggaggtaatagtacctctcatcactgtatttttaagcatagtgttttaccaaggaattaagtgttcaaaagaatattttctgaagtggattttaaaacagtagtaataccatttgttcttgaggtttgtgggttaagataggaaatgctatatttaagagtctaacattaaggttttcaaccaggcatggtggctcacacctgtaatcccaggactttgtggggctgaggcaggcggatcacttgaggtcaggagtttgagaccagcctggccaacatggtgaaaccccatctctactaaaaatacaaaaattagccagacgttgtggtgtgctcctgcagttttagttacttgggaggctgaggcaggaggatagcttgtgcccgggaggtggaggtggtagtgaccaagagcacaccactgcactccagcctgggcaatggaagtgaaaccctgtctcaaaaataaataaataagattttcatctttgcgttcccattcactcgctttttgataaatttaagctcttatgacttctaaaatattgtaatatgtacaataatacttaatgttattctacattgaacaaacatttaatgactgctatttcgagttacatactggatgctggggccaattgcaagctaagataattagtcagataaaacagaaggaactccatatgcaaagaactcaaaaaggctgcttactagacagtagctttcgctggcctcaggtacatgaagagaccatgtttgtggaagttgaagctggaaaggtagccttgccattctttggagatggcaccttatagagccaatgatctatagtagcattgtccagtaaaactttgtggtaatggaaatgttctctgtactgttcaatatggtagtcagtagtcacatgtagctagctattgagcctctgaaaggttaccagtgtgtcttagaaacagcattttacattttacttaattttaatttatttacatgtgaatagccacatgtgtttgttttgttttgttttgtttttgagacagagtcttgctcttgtcacccaggctggagtgcaatggcatgatctcggctcactgcaacccctgcctcctgaattcaagcgattctcctgcctcagcctcccaggtagctggaattacaggcgcctgccaccacgcctggataattttttgtatttttattagagacggggtttcgccatgttggccaggctggtcttgaactcctaacctcgtgatctgccctcctcagcctcccaaagtgttgggattataggcatgagccaccacgcccacatgtgtatattaaccgtgttttcaattttctgtattttattatgctttaatatcttaggagccttgttggctgtggagacaatttaattcctagagatactaaataacttgcctgtgagcatgcctttcatatgcaaaccaaccaatccaaagcccatgcccccaaccacctcctttatctaacccttacacatgaagtcagtatttctccagtcaatatttctcctgccctaagtcaccccagggacaggtaggagacgactagggaccactacttttgcccagaacccactgaaattattcaagctagccagtcctgaacagtttcctgccttgccttttccatggaaaccacagtaaaggcctgtgcccatgctttttccctttcctctttcttcctcctgatcaaccctagtacctctcatgtggccctgcattgcatagtgtatcctctcctcttgggaactataagtaataaactgttatttcaagacagtttctacaagtctgttgggtacaaatctaaacagtatggctagtggtgcccatattgaatagcacagatcttatacctaggcctccttctccccgcaaaaacagttctgtgttatctccagagctttaattcactcaaagaacctatttggagtgtctccactttggttatgagaatgtaacagccagcatggcagacaaagttcatacttttacagagttttattctggtaactacaagattatattcctgaagatttttgcccatatagcattgtcaagttatttggcaaaatatttttttcaaaggagttgctagtacttcctcaccaatctctataatctctgaataaaagctaccatttattgtgtcttttttgccagccactcttataggtgctatctatgaaaatggtagataaataggttttttcatttagatttctttggcatgatgttatatcaaaaataattccattttggaagagttcatattgtctttctttcaatagttaaatagtactattatctcctgagagtagttttaccaagataggcacagattttaattttagatctattgggtttgattcatgataactgacaacaggctttggatttagggtgtcctggactaaacctgcttaggctacagttttctcacatgtaaaatggggataataatgatacctaccacatatagttgtttaagctaacatagtgttaaatgagctagtgcccttatacccttagcataacctgttcatttatctttaatgtttattagcatgagttagcatattattttctgtttttctcttttctcaactaagctatttccacatagtgcctagcaaggtatcagattcggcattcagtgaaggaagttaactggtaattctataagaacagaaaagagcccagcagaggcagggtgctagcagacatttgataaatgtatgttgaaatgtttatcttggtttcctggtatttttgtgtccacatgcatagggactgtttcatttgtatcacttatattccctgtccccttaagacaggctaggtactccaaaaggctttaaatgaagtttatggaattagatgtatcttaaaatgagaacattcaacatagaaggtttcaatttgttctttaaaatagtagcttttacacaaaatttcagtgttctttagcaacatttaccaaaaatgtaccttaaagcatcagaggacatgttctctctgatattatgaatcagtggtaaaaattctgcagatattctgttgtatgattttgacatagtattaaggagataaaatgttttcttaacttataaaatatacattgaattttgtttatagttatagtgatcataactcctaaaataaaaatagacaaacacaaatagacttgatgtagacaatgagataggatatttgaaatggaacctatttctgaaaagttaggtttctagtttcactggtctcaaattataaataaagtaaggtggtctttggtagagctggctttattgtgttatttattcacagttttatggatccattaaaaaggaattaatgtaaaaagtaacaaagaataagctcaaggatgaaacgacatgctattttgaattcttttccaagagcactgcagattctgacacatctacatgtttagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacggtaagatgtctgtttacgtgtacactaaaattttgcagtgctaggattgtttcgcctcttaaatccccagttttgaagttctttaagatgagagaattttctgtaatatttggtattgaaagaccatattcctaaattgaagttttcatgtcatgatagatactacctacattagaaaagttggagcagcaaagaagaataaaaatctaatgccttcgcaatgtttggcatttatgtagagtaacatgtattttaaaatacacattctttgagagaggacctaaggtttaatggaaaaaagctttggtgtcatagtaaatagtggtcaaatatacttgtcacagtatgagtttggttggacaagttacttaatttttaatctctaatcttcagggtttgttttaacctgatacatccacattacatatctttgagaagtgagatgatatatgtaaactgctttaataatatgaggtagtaaatgatagcctcaattatagatgatttttaatgtgggaaggagtttggagtgataagtactataagtagttgacaaaatctgtttcttgtacttgatcatagattatttgaggtttttaatacagtattgctcatcacagcatcctttgtaatagcaaaatttttataaactaaatatctgataaaaagggaatgatcatgtttttaaaggatatataatgacatgagatcctgatatgagtaagaaagcatattacagtgtgatcccaattttgtttaaaaaacgaatacacgcaggccaggcgcggtggctcacgcctgtaatcccagcactttgggaggccgaggcaggtggatcaccaggtcaggggttcaagaacagcctgaccaacatggtgaaaccccgtctctactaaaaaatacaaaaaaaattagccaggcgtggtggcatgcacctgtagtcccagctactcaggaggctgaggcaggaaaatcacttgaacccaggaggcagaggttgcagtgagccaagatcacgccactgcactccagcctgggcgacaaggtgagactgtctcacaaaaaaaagaaaaaaaagaatacacacaataaatgcataggaaaaaatataccaaactgttaattattattacgtgtatctggatgggttatgagtgaattttttaaaatttatttttatttattctttatttatttttgcgggggacagagtcttgctctgtcactcaggctgaagtgtgatggcatgatctcagctcactgcaacctccacctcctgggttcaaggaattctcccacctcagcctcccaagtacccgagacacaggcgtatgccaccacgcccagctaacttttgtatttttagttagagatggcgttttaccatgttggccagactagtcttgaactcctgatgtcaagtgatttgtctacctctgcctctgaaagtgttgggattacaggcgtaaactaccgcaccagcctaaaatatatttttgttttcaaaaattgtgtggtatgcatgagttttatagcaagaaaaaattataatttattttgaattaaattccattgttttaaaattaagcaataggtgagctcgaattttaagctccacaaatgaccaagaacttattcgattcccttttaaacctgttgtctattttaatcactcatatggactcattcataggtttttatttaaaatctaaaccaaataatgaagtaactgtttaaattgttagattttgaatatggttcagttggatgtagaatgtaactattactcaggaaaacgatctgattttttttagcaagtgatatgctttctttctgagagcatttcacaaatgtttctacctaatgaatcatattttaaaaataacacttgtaattcttttttctttttagtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtattttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaaatttttgtgctttttaatcctactattatgaatctttttagtttcatcttacattactactctcataatagctatccttagccaggtgccatggcacaggcctgtagtcccaactgctgggaagattgaggtgggaggatggctgcagtacaagagcccaggagttcaaggccaggctgggcaacatagtgctccgcctctgctgggctctgtagggaatcctttctgttgtaaaagagttaccatttaactcccttcactgagtgcgtttctgagaccttgctaggcactctggaaactgcttagttgagaaaagacaaatacaaaagcttttctttagtctatttaagatacagtttattcagttcactttgctttctttttataagaatgtacaagaggcagacagaggtaatccttctagaaataaaactaattgttattgggcacttgtatgtaccagacactacactaagcatggtacttgggtttttaatttattacatgtaatgtcagtaggttcaattatatgatcgtaacatcttcatgaccagcagcatgtattttagagttagaaatgtagtctggtttttgagaagttttacaaggtgtatgtccaaaattgttctttcctcacatgtcagtgggggataaatacagcattgctctcacttctttgactctgggtgctttttcggatacattttcttcaacactgttaaggggcctcactgtcagattaaccaattatttttccacagttggtcaccagactttggaaaaaatccacctcaccaaaattttggatatcctgatctgtgttcatgaaatgctcttctttttgtaaaatctatcactgcatctcacagcaacttgttttcacacatgttctagtggttcccataacttagattttacaggaggcaaatttactaaaaatgaggagactaaaatgaatgaccaactttgaattttgtcaaataacattgaaaatgaattatctcataaaaggtaattttaataccccaaaagtaagatggttgtactctcagaataaagacttttccctgccacattttcagttgttaaaatatgctaagagctatgcccatatcttttcccacctgtgcacatttttcagaagcgtagggttggtagtaagctgttgctttaataactcctttaaataagcattattagcagtttgcattacttcttgtaaatttacacaattttatcttgtccatctttaaaaaatagacatctaataaccaaatgtatttgaattgatgcagtgtaagtaacttgtagaacttgaggataagtggtaaaagaaaaaaaaaagtaacttggctcttgaaatacatgtcttcggtttctagagccttcaaaatacagccctgttgttactgcgtcacattatgattgttttgaggactgcttctgcttacctaggaaactactcatgccttactcagcaaatgaacatcactattacataaacatcaggtatccaaaagtgttagcaggcttgaggtatgaatgattcattcatatgggtaattaagcaagttgaattatggaaagcacctcacaattcacacaattcagctttgagttcaatgccaaatacgatgattcattaagttgcctttgtattttgtaacctaatttgttaataagtaagttacaggaagccaattaagccagctgctgatctatatagtactaccttcctcattgtgattccatagtcttccaatagaaatgtgctgtcagaatctgtatagagagtttgtaaatgccactatttaacaaggttcttaagaatttaggtggatgttttatttgatacctaccaaagaagcctaagtaattgtataatacttaacccatttagaattcagttgtggcagcataaccaatctggagagaccaggggagatgttactaatgcttgtactttattcagaagtgagtgcctcattggcttggtgcagtgacgacacacctgtaatctcagcactttgggaggctgaggtgggtggagtacttgatctcaggagtaccataccagcttgggcaacgtggtgagatctcatctctacagaaaaatgcaaaaattagccgggcacagtggcgcaccagtagtcccagttactcgggaggctgaggcacaagaatctcttgagttgaggaggccaaggttgcagtgagccaagattgtgccactgcactccagcctgggcaacagaagtgaaaccctatcttaaaaaaaaaaaaaaaaaaaaaaaaagtcttttttttttttcatctaatcaaatttattgtggcagaaatcagtacgaagttcgtaggacaggaggaaaccaatataaatatctcagcattgtaggaaatttaacccatggaaagcaggggtgaattaaagaccactttgaaggctgggaaaagcagataatttagatatagtcaaagtatgaaatcattgatagatccagaacaaggaaatgatgtatgtgtttacatattacatctactttattaacaattttccctctgttaaactaatatcgactaatagtagtctaggtaagtcaagttcaaattaagtggtaattgaaaaagtcttctttttaaaaaatttttaatggtagaggcagcagctacccagagtctacttattcttacttcacattgaattctaacaagtttggttatctgatttctgcttcttaacaaatcacaagtatcaaaagggtcttgcagaaggggtgaactacagaatgtgacagctgacagcaagtcaggggaacaaaaataaatttaaggtgaacattaaaggcatagcagcttgagacaatttataggattctgcatacaactgtctctgaggacatcactgtgatcaaattatacaagtgatgtttagtgatgaattggaatcaagataagtagtatgtgttattcaaaaaggcaggatatgtgttgcatttggtggtaacaatttccccttagctatttagttaaaagcttagtgcttaacatgttggaaaatttatatgtaaaatatattgacttactcgatgattggaggctttatcacaggaagttttcccattcaattgaaacatttttcaagcttaatgactataatttactacataattatttattttgttaaagtttgaggaaaactaaataaagcagtagcaatttaagtcataataaattttgttagatgacttcttccactttagggggaattaaaaatcatgtttaaaaaccacatgtgcagcagttctgtgactccctcaacatccggttggccatatagtccctttgcaccacagaggttggagtatagaatatgcccaaagctgttttgttttgttttaactatgcttcatcatctgaggttgtgttaacatagtttgtcctaatagtcttttactggaaacttgctatatttgatcatgttcagcaagtaaactaattttatctactttcatatattttgagacaaagtctggccctgtcacccaggctggagtgcgggggcatgatcgtagctcactgcagcctcagcctcttgtgctcaagcgatcctcccacctcagcctcccaagtagctgagactacagtcatgcttcatcatgcccggctaattttttatttttctaagagacagagtctcactgtgttacccaggctggtctcgaagtcctggactcaagtgatcctccctgcctcagcactcccaaagtgctgggattgcaggcatgagcaaccatgcctggtgttttatcttttgcagaaatccaatttagtaaagtcatgttgtagcaagcatcactttaatataaaaagtgtacagcttatattattagcaattgtactgtttaattttatattagttatggtcttgaaggacattgaaaatctgttcagaaagactatgtttttcaaccagagatgacatcactctaactttcctttggtttaaatgcttgattcttcgcttacaaaacttctgttttgaacaactatggtgagaaagtatatttgtgatactgttttcttagaacactgttgtcagatagatcagccataatgttaacacatttctgatctctattataaggctgtaattttccaaaataatacagaaaaggagaaaagggtagtacatttcataattagagataaccctgtactagtgagaaaataaaaatgtcaagtttattaa

SEQ ID NO: 2119 - DNA, 22244 bp, Homo sapiens
gtgcatttatttaaaatttatttgttcatagctatacatatattatacatgtatacctgctcacagcataaagtatttcatgacatacttgtaagagtcagtgttctatgaattcactagagaagttacagcattttgattatgatacacgaaaagaaacccaagtcatttagcttaactccttaatttcataaaccagaaaactaaaatccaagatagattgggtgacttggtctagatcacaaaccaaagttagccataattcggtagtgtagtgcccggtccaaaacctcatagataatcttataatcaatggactctttctgaatgctagtcaaaatgtccttttgtgtgaattttaatgtaccgtcatcaactgcatgatattcttccccatacacaaagtgttatctttttgttgtccatttcagaattttccatgttaatattaaagttctaggaaaaaaggctaagaatcactgcacatttattgagtatctcagtgtgcatcataccatttggtcatttgaggttgcaacaagtaaaaaacaaacataaaacccttaaattaaaataaaaacaaaaaactttgccctgacaatgttacagaattaacatccataaatttacttttcttgaaaaatttattttctttaatttcgtttgtttcctgttacataatttatatttaaatttacatttatttatccagaaactatgtccaaattttatgtcctcttttctgttatcctggagtttggtgaagaaatctgtacttaatttagaaaagaaatccctctaactgacaatattgttagctaactatatatttcttaggcccatgtcaaatatcattgcttattttaataaagattgtttagttagactaagaaaatagtaaataataagggatggcatccgttaagtataaacactggattatttttcataacataacaggtcaacaatatcgttttgaggctgaactcctttactccttttactgtaagctattgaagccaaactccttcctacctttgttcatttatgatggtgtaaaattttaaaattaggatctacatacagaacaatgcagaattatataaaaatatttgaatattgaaaaatgaagtggaaattattattattatttaggtacagggtcttgctctgtcaccctggagtgcagtggcatgattacagctcactgcagcctcaaactcttgggctcaagtaatcctcctgccttagcctctgttaaccatgctggtcctgaactcctggccgcaagtgatcctcctgccttggcctcccaaagtgcaggaattataggcatgagctaccatgcctagtcctgaaattactatcttcttccttaacccccatctcccccacaaaaaaacaaaaacttccttttttcttcatatttacattttaattgtatatgctgcaatggcctatttgtatcaccccagagtcatgtgttgacatcctaacctgcaatatgatacattaggaggtggggcctttgggaggtaatcaggtcataagggtagtgccctcatgaacaggattagtgtccttataaaaagacacatgagcgctcgctttttttctctgctcttgctatgtgaggatacagcaagaagaggaccatctgcaaaccaggaagtgggccctaaccagaaactatatctgctggcacctttatcttgcacttcctagcctccagactgaaaaataaatgtttgttgtctatgacactccatctatggtaatttgttatagcagcccaaagtgactaagacagatgctaacaaatcgagatttattttaaaaactattctcctgctatgagttcaatatttttatttctttacaatgatttcagaagagattacaaagagattaatatacttaaagaatcagactcttgcaaacagtgacatcattaaaaagagcttattttcattaacatgtgattaacaggaaggagatgattggtgagttttcttcgtaaccaggttcactgtggataggaagggcctgccttccttcccaccatggagatcctaaaatcacaagctccagcctccatcaatgatgacagggttaccagttacataagcagactgcagtgataaacacaaggagacagaacaattaaccaggtttgatacaggctgtattttgaaattttcctgtgactaggataactaaacaatttacccttgtcctaacaggaaacctcacttaaacacttaattcagggaaatccaaattaacatttggttgatttagaactgctgagtgtcctgtgatctggaactaaatggcctctggctggtgtctaagcacctgtcactgttaggtatttggtctcagaatccccaaattaaggaacagtgatgtatagccattccccaaattaggatataggctaaaagcacattttcattttgaaactcagaactattcaaaactagctaagttttatgccactaataaacttttgaacataagtgtatcagtcataaaatggtcatattaatgaccagttttttaaaaaagacagcatatatttagttgatcaattataagtggataattgtaggagctgaagcacactaaatgtgttttaaaaatttacatgaatgataataactataatccattaagctataaaaatattctatattagtttcagatatccaaatctttataaaactaaggaatttaaaaaataattactggtttattcccataaatttttcattttctaaataaggctgaagtgatctttttggtagaagtttaaaaatcttttaacttaaaatggataataaagactcaaacagtctaaattcatctgaagcctgaaacaatggaagaggaagtaaggatatcataatgaatagagaaattttaagagttcaatagataaaagctgataatatacagtaggtgaactagggagttattagtcacttcaccaaagaaatacctccaactcccccaagttcttttaaaagacaagctctgttacacatatgaactcctctggaaacctctaaaaagccaaaggtacttttgtagcacatttcaagccacaacacttccaaatatcttgtaacctaagctctggctaactaagggtaatttagcttatcagcagtacccaaatcaaatgagctattctgaagatacggattcagagaaatcacaaaggctcatgtgcttcttcattaaacatttgtctattaatttccccagctattaacaattgttgttaatagttgggagaagttctgagaagaaactgcgctgtcacggaaacatttcaatccctgtatttgtcacattcaccaactatctggtgtgcaccaagttactgggaagaggagctatcagttgttccctcctcgctcccgcctagtcccctttccttccctcttctcacacattacagttccttgttcctgtagtattcagagacataaaacagaggaggaccttcttgtgctctataccttataagcatcatttttgctttcatcttaagccatttaaaagtaaacaatagttattaaggaaaaaactgttaaacagatgcaaagtggaagagattaaattaggaatttccatacacgatgatgaacaagtaagaatttttaaaaatatttatttattttgagacggagtctcactctgtcacccaggctggagtgcagtggcgcaatcccggctcactgcaacctccgcctccctggttcaagcgattctcctgcctcagcctcccgagtagctgggactacaggcgcccgccaccacgctcagctattttctgtttttagtagagacgaggtttcaccatgttggtcaggctggtctcaaactcctgaactcaggtgatccgcctgcctcgacctcccaaagtgctgggattacaggcatgagccaccatgcccggccacaagtaagaattaatagagaaaaaagagccagtggaattctcccaaacaagtcacaagtaaaactaaaacaccacatgcgaattctgtgtccactgaacacaaatctgcttaatcctctccccatttcacttagagctcttataatcctggaggttcaattttttgacttgcatttaatcagggtttccccaattataatttttgaaaggaactgtctctcagaaaattgagcactttaacttttttagtcctccattttgtttgctacaagattttatgtaaagctgaataaggaagaattagtggctcagatcgaagtggtctttctttgagcaaattaaatgagaacttatccctatcttataaatgtagcatcttagcacatatatgccacaaactctctaaaatgatattattttgatgagcaaattgtggccaaatgtgattgagggtaatgaactccttgggaagaatagtgcttacttcatcagaagccaaatacacgcagagcatggctatttcttctgcagttgcgaatcttcccgtcttttgtctcttcaggaaatcattccgtgcctgtgaccagagaccataccagacattagtgatggaagcagctgtatgtgctcacctgcatcttgttcaaggagttaaaggcaagagaatccactggcttgctgccttgatgaataatcaactagggttatggtgattcttttgccaaagttactcaaattgtttgtgttatactaaaacccacagatattgtgacacatcagaaagctaatgttaaaggatgagggcattattttttcatcttcaaaagttgtggtaaagtatacagaatataaaatttactatcttaaccattttaagtgtacagttcaatagtgttaggtacattcacactgttgtgccaccatcaccactgtccatctccagaactcttatttttattattattattttttcttagagacagagtcttgctctgttgcccaggctggagtgcagtgttgtgatcatagctcactgttgtacctcaaactcctgggctcaagcgatcccccagcctcagcttcccaagcagaactcttttcatcttacaaaatggaacctctctactcattaagcattaactactcttttccctccttccaagcccctggcaactaccatttcactttctgtctctatgaatttgtctgctataggtatggaagagggcatttattaacaaaaggtttaaatacattttaaatgctagatgtacctcttcaggatttcctctggcttgtattctttcttgtagagatggcgtatcaactgttcctaaatcaaagggggatattcagcttggttactcactttcactgaaaaagaaatcgataactaaacttcctttccatatgacaatcagtgagattcttctccttgacttaaaatgacaactttacagctgcctgcctgaggcctcttatttaataggcttataatttcttcaataacatttctatgattttaaaaacacagactatgattcttcgtgacactatgtagggactctggatgaatcacccagcattctcaaggacatatattttagtcacattgcatttatatgatgctttatggattttaaatacatttatgcatatgatctcagctaatcctcacaataaccctgagatgtagataaaatcgtacaagcactttgccagcttaaggagccagtttgcctcaatgatctcaaaaccattctttgctgtcaagttcactgtggcatctttggggacaatcccatggctaccatagtccttggtaattcaggtggcgctaaatttttcttatcaccttgcctattttcattgtttcaaatgcctacttttaaccacagtttcaagtttttaatcaaaaatataatttaatctaatttaaagttattttactttaaaaaagaaaaataagaacaacgctaacattttaaaattccacttagtttatggtctcctagagcacgttacccagacttttttgttaacggacataaactgttcattctctttagagggccctttttcagactaaagagtactctggcaaataatgtgatctttctgaggttgtaacaaatggttttacagtcatacttcacccttagatcatgttcctgagagtgccatagatttgatctttattcagaaaacatttcttaattttagcatcatttgctatttttttctgatgaagctggaaatcttcaaaatcagaaagcctgactccattttggaaccccctctttaggttggttatctgtctcttgtcacattttactataagcagccagcactttcaagactctgggtagaaatcaccttaattagatcacccagttcattaggaacatcttctaccttcacactacaggcaacagtgttgatgtactttctgaaactgtatgacaaagacactcttttttctaattttcaataatattttcctcactttcctcaatagcctccttaaagtccacagttttaccaacagtgtgcacctcaagctttcactaacactccttcagaatcttacagctttaatagctttctccctctgaggtaaatgaacatcatatcttacatatgactggtactaatggctattaaataagaactgtagagcaagcccatgcctttagagtattccaatgtcactgggttcagctgtgtccatggcacagacatactatgccagggtctacacaagtctggctggagatttgtgactatacaaccatcagcagcatctcagacatactcagtcctcctcaagttttcttctgtgattggttcactgagtcacagctagttccttgttccaaagagtttgataacatattttccaatctcctgataagtccagtcgctgaaacaaccacattttccaaatcattttaccacttattccactgggtaaatggcaccaagaatagctagactcaagtatcgccaggatgtacattaaaacccaatgaaatgacctctcatgcattcttctttttcttagcgttacctacgtttacatttctgttccaagaaaaataaaacagaacatctcaatcgctgaaattctgtagcttgggggatgtttagtttcccctctttaagtcagtgggtttcaactgaagattcaatcagaatctcttgtgggtctttctaaaccacacaattctctccatgaactccttccctaaattctggcatgcccttcaggtttgaaaggtccccaggtcatattgaaatgtttccctttcacacaccaccccccattatcaattgtgcactaccaagggaaaccttgatcctggatatgcaatcatttctttttaaagaatattataatccttattagataccttaagttccttttagattggtagaaccaggtaaaagtacatatcaatttaataaacacatctacggttattgtgaaaatgagacacacccctatagttattaagaaaaggaaagttctgcttttcttctttgctttgtatgagggatcggcacacctttcttggtaaagaggcagacaaaaaatatttatggctttgagagtcattttatctgttgcaactattatactaaactctgcctttgtagcatgaaaacagccataggcaataacataagcaaattgggtgtggaagtgtttcagtaaaactttgcttacaaaacaggtgtgccttactcacctgggcacacacagttgcacctgatgccctgctggatgaaatctgcagccacagattttgtgaggccaatcacggctgccttggttgtgctgtacacacatctgttcacaactcctgagggtggaggaaaggttcaacaattgaaggaataaaaaatgtattttccttcagaaaggtaacacaaataagttttcccagtagccattttcatgctttctcccacattcctccccttttaaaaagattgatatcagatttttttccttcaatagagtcagtttctggatctagggaaataatatcagtataggcacaacttaattgagacttaattgaaatgctgaacttacttaacattggtagtcttagtttctcatcatcagttgccataactcttaggcagattccaaaagaaaatgaagattaataacaaaacaaaacaataaaacaggaggcctaggcacttctttacattcctctcttgtgtatgttgaatatgtgtatccttgcaaagagaagaaatggtatctcagcagtaactatttcattttaaactcacagatccaactatgccagattgtgacataatccacattttgtactgctgtccttgtccttcaacttgacttcttgctgatggctcagatcaactgtctttgtgaagcattccacaaactcacaggcagttatttccctgtattttgacagcgctttgtacaaacctctgttatatatcatcacactggagaagatgatgtttgctgccttgctcctagttttggactgtgaattcttttatggccagagcacataccggtgctcaatacactattttaaattaattaaatgttaaatggttctttctcccagtttgatgttcatttccatgtccattagaaagaataaaagggagggcaaaaataccccacattttaatttaattttaccactggctcacatcgagagcaaaagatctgtggttaaggaacttaataccaattttgaaaaaagcagttttgaaatcatttcaatacttgaaattataatctctgctatgcctgttcccaaacgcagagctcttaatgatgtgcgtgtatgagcatcgcagtcctcggaaggagacagacccacctttgacgctggaagccacagaagacatgttgataatattgccagatttctgagcaagcatctgccaaaacaaaacaaatacaaaaaaaaaaaaatccactttgtgggctaaaatactaccttttaaaaagatttgcattttcttagggtttgcagaatgaatttaattactgtattagctagtcacattaagcactattaagcagtcttaacagtgaacccaaaacacctcatcaactattgctgggaaatgatggcaatgtgactgcactcactggcatttcccagggggattaccaccttcccatggtacaagaatgtcagcaagactacgagtgaatgctgacttaaatgaaatgtgaataaatgttgttattgtgtgttactgatgttgggaaacttactccattcaacacataatttttgaatacctactgaggccaggtattgtgctaggtccaggagattactgcctacaggaggcaaccagtctggttagagtggctcacataatccacatccagccacagcagagacctccacagagatctaacagcagggtgagggcagaaagggagcaattcaggctgggcgacactcagaggggacctcctgagaaggaaggatatgggctgaattttgaacactagagtattagtcagaaaaataaaagaaaaggatgttttgaggagtgggtacacaggtataaaggttccatcgggaactgggaggaggggctgggtctggctggaatgcagggtgtggaagcaatgaggctgcagaggtcaacaagggctgaatttagaacctgggttttaccctgaaggtgatgcagtgacactgaagggtttaaagcagagaagtggcatgttcagacttggggattgcaaggattactgtggtgcccagagactagtggaagctgatgcaggcttcaggaaagagtgataaaggtggagctgcagaaatgtctatgggtagctgaggaggagagggctgaggcaggatgggcaggaccttgtagatggttgctgcagggatggtgggcctcaccaatttagggcagtgtttcctaagaacaccttcttcagaattcccccactaaagtgtgaatttattaagatgagggtctttggctgttttgtcctcctagacagtgtacacagtaggcagtcaataaatgttgatgaatcagaatctcctgaggtgctagtttaaaacacagattgctgggccctgtcctatagctaaataaatatataataaagaaaactgctatgaatttaaaaatgttttcaaactttactaattataacatgtacatagaagtctcaataggcagtgtaaagggccagagaaaaaaaatgacttctgttgggacgagtttctttagcagcttttagaaaaagaggtgtaggaaaggaaaaagtaaataattgaatggatccaggattggtgtggccaagatgattgatttcttaggatattcttctgactttgttctgagatttagctactaattgcccctaaaaacagaatctaaactaaccccaaggcactatgctgaatggagtaagtggatacaaggagaggctgactgtaacccaaccaagctaaggaagacagcaggggaaaaaataatgtttaacttaattgtgtgttttatataataaagaggatcataatgaaatggggttctcataaaaagtgtcaagaatgttggtcaagtgtaatggtgttgaaaagtaagccttaaaattgttctttcttatccaatttagcaaatagcattccccatttaaaatacatatagaatacatataccccaatttaatacataaagatgggttattatgtaggttcaatctctagtcctctctagaaatgcaatattatctcaggcaaaaccttagaataaagccacctaagagacattacattagtgctgccccctaacacttgcactatccattcaaccaagttcaaccgaggtccctctgctgcttctagagcccctagtcagtacctgttcccatgctgccttcccagtccaggtcaggagctgtcgtcatggtgtcaggctctccctggctccccatgcaatagccttctctggcaggcatgactataaagtcaagtgcctggtacatagtactgctatctaggattgacctcccagaagcttaggtaggggctagaaataccccttaagagtccctggagctgtatctagttagtcttactctgacccagcccttctgtctccattggccagagctcagcccctaaccctggtggaacctggccacttgggtctccagtggttcctgctggactaacaaccttgattcatttatttatttgacaaatgtttgtggagcacctctatacgctgaagactcttctaagacacagcaaggtgggggaaaaaagcaagcaaacaaaccaacccaaataacaaagatatccccaaatctttgccctaatggatcttctcttctggtggagcctggattctgcattgacctcttcttaaagtattttcaacttgttctctgccttttgactgatcttccagtcttggaatgctttcctgtgtatctatccatgaataaaaatttcctatgagtgttcctatgttctgaccagctgaccttccagagctgcctagactccaaatcctagcttcccctggaaagttctaacatgggatatgtgtgtcatagttaatgatacagaggatcatagataattatggctggaagtgattgtgtaacctatcatcctcattttttagctaaaagaaatatgtactgagagggtacaagtgccatctctatggcacatggccaattaggggcagggcgcagactgcacctaaggacttctgatgatagagtccaagaccaggattcgattttgtcaaggtcactttaaacaagaggcactaataccatattcctgccattaacatctcttgggatttttttttaaacaaatctgtgtttttggcccacatggataattgttaagatattgtaaatcacaagcaaactcactagtttgcaagttaatgtttgtatattttaaaaattaacacaagtttacatttcagctccactgtactccacacctacttcctttactaaaatttgtaaagcattttagagcctggttttgcaaatgagtctcatgcatgtgcaacagtcttacccacgatgacctaagctttcctcctataccacagtctctgctctacccctgtaacctatgcaaaggatctgtcttcaaaaatacattcgtgttccaaatactatagtttctcataaactccaaataggctaaaaaatcaacttacattaaaaaaaacaatttgttataaaaatttgctagttcaacattctgtggacccacccaaaaatcccttctaagcactaaacaagtagatttttcaaagtcccttcattactaagtcagtttctctaattttcctgttaatgttcatctggaaccttcttaacattaggttgaatattcagagtagaatatcagccctgctgtgccattaacaaagctcttctcctgcccagacatggacaggacatcaaatccagctgggatggaagggaaaagttgttcttctgcatttcactaggttcaatttacaaccttgagttgagctggctctgtacccagtcaacccctttcattgtctcagcctgcactgtctgctactactggtttataagctcatttgaaatcagggatgtacgctgctcatgtttatactcccctagaacactttatatagtgatttataccaagaggtacttaatgctagtttataaaataaaattttaaacattgatgcgttgtgtgaaggcttgagaattcaaggaggaatgctgtcttgagcacacactgtctctcacctgcccagtaccactgtggttcagatcaaaacaagagcgaagggagaagcttcagggcagagaaaagcaatggggtacatccctcttgagagtgtgagcctagactgaaattcacgaaggggctcaacgtccaggcttcaaatcttggttctaaccatgtgctagttgggtgaccttgagcaagttgtctgaactctcagtttcatcttctgaacaatggatgagataatagtatctacctcatacgatcattccagtctcgtgtgcctccctgctgttacctctgcctggaatcatctcccaaggtacctgaatgatcagctgtctcacttcttggactgctatgccagtttcacctttgcggtggagtccagaggggccgcattgatatcctagcttctttctcttcattatatttaaaaccacgccacatattctatgtctatttgattactaattgtcccatctcacccccaataatggaacctgccttatagaaggcactttgtttagttcacttatgtgtcttctgtgcctagaatggagcctggcatgtggaaagtgcttaataaatattccttgagtggatgagctggaaggttaaatagattaatttatgtgaaatgccttgatataaatgttcaatgcaagttaatcattgtgttagttattatcactcttcagcacatgtgggaatcccttctgtgtgcccagtacagagacctaatgtggtgcttatcctggtggtggtggtggtggtcttactttaggaaggaatgccttgatcatcaggtacatgctgcgcacattgagattcatcgagaagtcccagtctttctcctcacaatccaggacagttccatgatggacaaaactagaagagtgattaaacaatggaagaataactgccattaaaatttttctattccatctgctgattatttttattgtcacttagtgacttagaccactgtctctttcccttatcaagactttaaacaattcatagtatcacttagtatattatattagtaagaatcccaacaacttaagctagaaatgtcatctgaaaacaagatccttgttttccaaacaaaagtatggtcaccgaacataagaagctttatattaattgtgctggaaacatcaatgccattaaaaacaaacaacaaataaaggcgaacagggctaggcatggtagcacacacctgcagcctcagctactttgaaggctgaggcaagaggaccacttgagcccaggagttttaggatgcagtgagctatgatcattccactgccctctagcctggggaaccaagacaaaccctgtttcagaaaaaaaaaagagagagagaaaaaacatctgccctatttgcctatgtgattcctatttcaagagcaacagtgccctcaggtggcacagatttagaattctcaagggaaatcaaaattgcaaggaaaacaagtgtctgaacatctcagagcagcaaagtgatactgctagtgttctaacatactgagagatgttagtttgttgtaagagagacgttaaggcagaacaaaacaaacccgtaaagtagctttcactatttttcaagttacgttttctgagggaagcttccaaaacactggaacccttactgatttggtcctctggacccaaattatgtaattcattataaaatattgttggctgtgacttccatgtaccaaagctctgctatttcagtcagaatgtcagtttcatgacagcaggaaccacatgattatttctacatcccctacatggctgaaaatttaatagatgctcagaaactaactttgctaactatttgtttcatgtttctgggtgtattcttacatgaggatggaagactatttataaaatagatgatcagaaattattgctttaatttaacttccatacattgtaacacataatacagctttgtatcagtaccatctgtcttgagtagacctcatttgccccagatcatgtcaaactctaaggctgtcttacctgctgaattttatgtgtaatgaaaatgctgtgtaaaatctagccatatttcccaaggaatatgtcatggttcacaatgaatgattttgccacattatgaaaattctttgaatgaaagtcatagaaaactttctgtaaggaaagtgaaactaaaaagttatgaattacccagcaacattaaagagaacatcaagtctctcaacttcattggcaaactgatcaatttgtttcttctttgtgacatcaaggacacgagtttgaatacctgaaaaataaaacaagaggcactattcctaaaaatgtttagccttgaaggtttagctgttttgaagtgtgaagtgtgaagattgcaacatctatccagctaggcttcatagattgctgaccttcttactagggtcttaagaatcttcagagtctcattagtaaacttaaagtccatcttgactcctccaataacccatccgtccctcttccttcctctctgtccattttccaagttgaataataagggtcctttctgagcaatggctttatagtaaagaatgactggtgtacattagatgtttctcagtaagccagcagtaataactgaaaatgggctcatttgaagttcttacaaacttcaaacattaattttctcctctttgcagcttttctcttaattttctcttctttgaggtataattgagaaataaaaattgcatatattcaagatgtccttcccctatccttcccctgccagagactgggttgctggtacctatacagtaatcagaattttgtctgagtgaggggtggagaagagcaagtgttctggaataagagactgtttctatttgtgagcttcccctttatgtcatttccattatttattagaaatgactctgttagtcaagggtatccagtcaaatacatgtatttctggactaaactgcaaggagaagaaatgagagggtcagaagaagggatgacacccttgaaggctagacatgagagatctggcatggcgggcacctgagagatacacactgcactagttgctgagaaactccaaacagtgtctaacaaaagcagcagtcatcattataaatatatacacatattatttataatgtgcataatatatattataacatatagtaatataatttataatatatacaatgtattaatatgtatacatataatatataataatatatgaataatacatataatatatagtaatataatttataatatatacaatgtattaatatgtatatgtataatatataataatatatgtataatacatataatatataattatctataatgtgtattatattttataatttataatatattataaataatatgtatatggtttattttgggggaatatagaaataaaagattcataaagaaagggaagacttgaaattttgtttcagaaacatttccttatctttgtgcttccccagtgcagcagctttactttgacttgtttgaattataattcaacatattccaattcaattaactaattcaaggaactaattgctgtttgattatgtaacctgttctattttgctgtaagggttacctttcatataggttctctgttctgatttctttgggtaaactgcaattaaaatcctttggtgttggagtttggttcagtggggtgaagaagtggtggtacacacctaataatctgggtactctcttagggtttctcatgatgatgtgtgattttagagctaagctgtctccagccacatgtggctactgagcacctgaaatgcagctagtctgaaatgaaatgtgctgcaagtgtaaaatacacatgaattttaaagatttagtatgaaaatattgagacgttggtcaaagggtacactcttgcagttataagacttaatatacagtacagtgactatagttattaataatgtattgtatacttgaaatttgctaagagggtagatcctaggtattcttagcacacacatacatacacacagaggtaactaaatgaggtaatggatatgttaattagcttgactgtgataatcatttcacaaggtattttacaacatatatgaaaacatcatgttgaacatcttgaatatatgcaatttttatttctcaattatacctcaaagaagagaaaattaagagaaaagctgcaaagaggagaaaattaatgtttgaagtttgtaagaaacttctaataatttaaataaaaaatttagtaagaaaaaattaaaatattaattttttaacttgagtgcatgttgagattatattttagatatattggataaaagaaaatatattattaaattaattttcacttgattctttttacttttttaatgtggatactagaaaatttaaaattacacaggcagctcacaacatgttactattggacagggctatcctagaggaggagggcacagaagtgaaaagctgtcatgaaaagttaacctaacaactagtaaattttcacatgtaagtttgtaattaggaactgaatccctcaaatgtgttagctaaataaaggattttaagtattcgtcctcaaatttttctatgcatgtaagtcacagatttttgtctataggttcacaaaatatagatttcatatcagagagagaatctaaaaagcacggcagtggagctcagtagctagggaattttctttcaacatgtgagcgccatgctttataataccttgcagacactgaatcccaaattcaagctgctgagttgcttacccgggtacttttccagttcctgaagtttggactcattaatgtctgtggctatgactttggcaccttctcttgcaaaagcctagtagacacaaagtacaaataaatcctttgtttacttgaataaactgtgctcatgaatggaacatcatgtggtctttttctcctttatcttattttcattgttcttttccctataagatagctagaattttaaactatctagtcttaccccttctccattgttattatttttatcattaattagaacaatgtgacatacattgtgcttgtcatctgacttagtccctttaagtaatatcaaacaaaataacgttcttaaaaaaatgacagctgttttcaatactctcaaaatactgctcttctgtaatgagactatatatcatttctgagtttgagttactaaactccaaataataagagaaaaattggttgtttcaacacttttcctactaagagtatgctagtgctttcataaatgtcaaaccataccctgccattatacttaaggtactgttatacttaaggtgccgatattagcttaagtggggtacataatgtaacagaaattgatataaatcaggagaacaaggtaacctgtcttataactctggagtcatatatctaaactgacacaatttcagaaagctgtgtaaccctgtttgccctctgtagcgaatatatcatgatgcagagaaactgaagtagagaagtttctcagagtcaatggttatcagtgatgtcatgtactaaatatgaggtattcattccttcatctgcctggggtcaggagtagggacctatttatttatttgtttatttttataacttaagacaacagaagcacaaaagtaaaaaaataaaaaagcagagcagaagtaaacaaccatggcatcagtccacataattcaatatgtcaagagttagtaggcaaacaacaaagatagtaacttataacttactaaggcagctgcttggccaatcccctgagcagcggccgtcaggatgatgactttcccatcaagtcgacccataatggaacctgtggtttaatctaaagacatgtgtgtttaatgggttatactgtagaacatgatcttgagcaggcagtaacatctagaatgaatagttcagtgtgctcttttaagaataatttagtgagctccttcaggaacttgaagacagcacctctgtgcaagtagtcccatcatctgaattctcctagaatgcttactctgcatacctagctttgtatatcaaacacatttaccataacccactgaagtaatgactggtgacagacattggccattttttttttttttttttttttttatgagatggagtttcactcttgtcacccaggctggagtgtaatggagtgatctcggctcactgcaacctccgccttttaggttcaagcaattctcctgccgcagcctcctgagtagctgggattacaggtgcctgccaccacgcccagccaatttctgtattttttgtagagacgggctttcaccatgttggccagactggtctcaaactcctgacctcaggcaatccacctgcctcagccttccaaagtgctgagattacaggcctgagccactgtgcccagcccagatattgcactttaacctaccttatccttccttcagtacctggagaggacagcctctggtgctgagtttcctcactaccaccatcactctctccatgacccctgcacacattgctatgacattatttgtgtccttactactcagggctgcttcttgatttctcttccataaacttttgttgaggtttgcactatcaattgcttatgattttttttctcttgaaaagatttcatagttggtctcagatattcatcgaaaaaaaaaaggatggaaaaatcaaatcacatccaatactcccattttacagatgaggaaactgctgaaacatgcccaatgtcatagagccagtcaatgggaaagccagaactaaacttagacttccagactcttgctatgtgaacagtccagcccacaatgctgccgatcctcttataaagtttaagcatgcagtagtaacacattaacaggcataatcagtaatttctaaatgattgagaaacactgacaccggggctcatgtgcatgagatatttcaccagtgcttggattatagatcacaaagtgagagaaagagctagtagtgaggctgggggtggagaagagccaaatgaccatcaaatgaggctgtcttcaaggacacaggctccaagtcttgctgggctctgtcattaatgtgtgcctctgacctcatacgaactcacaaagtggctgctttgtccaaggcatcatatccacatttcaggcaaaaagaaagggaggagcaaaagccaaaaggctttcagagaggtctcacctttctatttaagaaggaaaccttctcagaaattcccacctgcagttcattcaccagatctatgctacttggccactcctagctgcaaagaggttggaagttgagacttttgtttccagctttgataaagtgaagaataggagaaagtgagttggatggtgttgatgaaccaacttacagtacatgcaaactagcctacacaatcactctgttccattatctgcctgattttgtacaggttgatagccttgcctaaagggcttatattacctagtcctttctctttgaacttatttcagttctctctttagccaaacttttttttttttatacccaatatgctcttccatttcaaacctccacacttggtccaaggtccacatggtgaagggcaagttactcctataggcaacagccactgaaggatttatggaaagggtgtgaaatgatcagattcgtattttggaaggactgctgtggagaacatacctgggcaggagcatggggtgccattaggaggctgctagggttatctagtgggggcgctggtgaaatagcagggctggagaaaatagcagggatggagagataggtggattggagaagtgtttcagagatgagataggtaggacctgatcaccaacgtggctaatttcaaagaaatgttatttgcccagtgttttgcagctatgaattcaaacctaggccttcttgttgcaggtccaagggaagatctcatggcattgtctcatggtactcaaagccctgcgggcctctctaaatccccactgtggcaccaggagcctgtgcctcgcagaccgctgaccccaggaagtaatggacaatgaggcgcagctgctgctgcctctctgggtttgtgctgaggccaccttctcggggccgttacaagccagtgcctgagcatgcatgcttactaaggcagactcatttctgggagacatagacctcctccccaacggatgactggctagagaagctccttattaccttgctgaagttctcttagactgcacagctgtctgggatgcttccactcaacctggtttccttcttttcctccctcgcgggtggacttgcatcgaggtctgatggctctcacagccttacctagttctctcctcattctctctcacaacagcatttcccctaataaaatccatgcatatttaattctatcttggagtctgcttcttggaggagcagactaacacaattatgtaagaactggctccagggatcagcttataatcactgacttcctctgagtttgtccacattttttaggcgatggggaagcttggctttaacagtgcctgacctactttgatgcaatgaatttttgcttttttacttcttacacaaaagataaacatggaatgtttatcatttcaacatggaatgacagtttctaaagtataactttagaaagatatactttatcctccttgaatcctaagcatggtgcacaaaagctattttacaacactgtcattagtgatattgggtgtatggccctgtaaagcctccagtcaaaggttttgctaggaatctttgccaaccgaagaagcacttccagaacaaatgccgaagcacagagcagcctttctatgcactctgaaaacctcctcttagctggccttcctgtctttctgggaccagattttggggtcaaagccttaacatttgataaactgtaatctcaaactaaaacagatttctttgagaaaatgagagcaaacacggcctgaaatggtaaaacaaggcacctctcaatatatccaatgtgaaaaccatacatgttggcttccttagtccaaaagttagaatcaaaatgttgatttttgattagcagagacacaaacagcatattcaggaagccattgttttcaagagccaggaagaaaactcttcacttaggataccgtaagaatccttttttcttgggctactttataaaacatacataccacagagtttcaggctctttaaaaacccatctttacactgatctaactgctcagattaattttgaaacaggcaacgtgcagaaaaaaacaacatctaaaaattaaacctcccctctttccgttctaaagtttcatttcaaaagtattaggaaatcttactttaagcagcgagctgatggcgttctccagaactcggtttgagcaacaaacttgagacaacctttgtctggaagcaagtcaagcg

SEQ ID NO: 2120 - DNA, 110870 bp, Homo sapiens
tattgctaagccatccttcagacagagagggagcggctgcaagaggtaatgaggtatgtttgtgaaccttgtattcttttacggttacagatgtgtgtctacaagtgtgtgtgaatttgagttgatctcttttagtcaaaatgcccttgttggccgggtgcagtggctcacacttgtaatcccagcactttgggaggccgaggcgggtggatcacgagatcaggagatcgagaccatggtgaaaccccatctctactaaaaaaatacaaaaaattagccgggcatggtggcgggcgcctgtagtcccagctactcggagaggctaaggcaggagaatggcgtgaacctgggaggtagagcttgcagtgagccgagatcacgccactgcactccagcctgggtcgtagagcgatactccgtctcaaaaaaaaaaaaaaagcccttgttaatttgttaaacacaaagataaacaacaccaataataaatcaaaaattatgcacatgcatacacatggaacaaaattctcatttatctttttttcttagtgtgtgtatatttttctgaactaaggctggatctataagcctgattgtagtgaaacctgtgtgtttgtgtgtgtttctgtgtgaggtgtgatgaattatttaatacttaggttgaggtagcaggcagaaattctttcagattctggaaatgaagtgagagaaatgaataaaaggagttagaatttgggagtgagattagagcattttccctctgaaaggatttggagttgtgattgagaaaatgtaactgaagaaccaattataatcagaaaattgagaaatatatcactatgcttatgggtttggtgcctctgttgattaaatacagaataattttaggggatagtctgaggatgtgtgtaaaatattgggatgcatttatgagttggtgtgcattggtgggtaggagaggtttcctgtggaatgtgggaggaggtcataaagagaaaggtagggtatctgtcctggcagtcatgtgtggagtagaatgggagtgctcgtgggaagaggagaaggtgataaattgttgttggcccttaaacttaaaaacttaaaataaaatacttaaaataaacttaaaataaaacttaaaataaaacttaaaaaaagttggatccttactagttgccagtctagctagacacacgcaggcatttcttttctgactggttacagaggtgggaagggagagttactcttggggaaagagagagaaattgagactaatccccatgggtctccctgaaaaaggataccactaggttcttcatgcaggatctgatcagtggctttgctgggcgaggaagacctcccaatgtccaaactgtctacagtctgtgtcctggtgtgggacagtaagtgtatgtctgtaggtgtgcaaagagggggtgagatggagggggtctttggtttgttgtgctggtaggtccctgtgctaccagggaccaaatgaagtgggacactaaatttaagacagcttgttgctatttcagtcacactctcacaagatgccaatgattattttttattatcaggcattccctcacaaatacattttaatgagctaataaaattactataaaaattgttctataagcatggaatggaactagaaaagaaattttccatttaaaatttgttcaggtggcagctgtggaatgtgatgagaaatataagcctttgcacaccctgttgctgggctcaaggaggagttagctgtctcctagagatgatccttttgcagttcagatggggaaactgagacccagaggggttaagtggatttttccaaggtcatacagctggctagggtcagagctgactcttaaatctctcaccttgggtgtgaccagacttggaagaaaaaagccattcattagctaccttatcccttcccattcaccaagcagctgggaaaggatggcccaacctactaatatcgcccagcatttttgatgaatagctatggctcactggggtcctctttgcaagttgttcttagtctatctatccacaatgaatcctcttttccactagatctcatgtcttgtgttagcaaaggattttaaaagaatggcttagacctccatatacacatcaaacgctggctataatgccggaaagaggacaaatatccagtttttccaaattaatttagatagccattttaataatttgggcccccatgtggtttgtctactttgcctaaagaactataatggtaccaggacaatgagctttgacaattattcatatactaaataattcaagaagaaaaaaattctattgcttttgcgtaatgtatatatagtaataattctttttttaaattttactttaagttctggaatacatgtgcagaatgtgcaggttcgttacatgggtatacatgcgccatggtggtttgctgcacctgtcaacccatcatctaggttttaagccccacatgcattaggtatttgtcataattctctccctcccctagcccgccatcccctgacaggccctaatgtgtgatgttcccctccccatgtccatgtgttctcattgttcaacttccacttatgagtgaaaacatgtagtgtttggttttctgttcctgtgttagtttgctgagaatgatggcttccagtttcatccatgtccctgcaaaggacatgaactcatccttttttatgactgcatagtatttcatggtgtatatgtgccacattttgtttattcagtctatcattgatgggcatttgggttggttccaagtctttgctattgtaaatagtgctgcagtaaacatacgtgtgcgtgtgtctttatagtagaatgatttataatccttcgggtacataccctgtaatgggattgctgggtcaaatggtatttctagttctagatccttaaggaattgccacgctgtcttccacaatgcttgaactaatttacactcccaacagtgtaaaagcgttcatatgtatatagtaataattcttatatttcagtaagattattttctgaccaacctaattaaaattgccacccttaccccaacattcctcatttaccccccactttttctccatatacttacacagtataacccagtgtatatttatttattttgtttattgtctcttttttctattcatgggaacataagtctcatgacggcagggatttttatctgttttgttcattgttgtgtagtcagtttttgaaagaatgcttggcacattgtaggaacttaataaataattcatgaatgaataaataaactgcaagcagatttctttcttccagagatgtagtttagataatgatgaatgatcttggcaaatgaggcacatcagtagcttcttctaggtctcccagataatttaaaacgtgctatgggccataaacttaatgtgtttttatttgataaaactataatctcacagaaagcccaagctggtgtacactgtggggcattatagcatagaatacagagtgatggttaaaagccatggctgtggagtccaaagggcaggtgttcaaattgtggctttgctccttatcagctgtatgatgacatcaggcagtttatttgacgtttctgaagcttagttttttcatctgaaagtgaggatagtagccatgattaacttgcagtcgttataaaaatggcatgtgacaaattatggaaacctcttaggatatctgctcaatcactgttaaccattattatcattagcattaaaattgcatagttatatatttgtcctataaaaaaatagtcaaagattaaggacagattgccaagtagcagttttttaaaaaacatttttaaaagcccttaaccctatttaaattatttccttttttatttgcgtcttgccatttttcctgatcttagtttttcttcaattgcatttctaattgagataggaagcttcaccatcaagagttctataatgcaggaagtaaggtcaatcagataatgctggagttttttttaaggtttaaggaaatctttctcttgtatagctagaaaatagatattattgttccatagagcaagtaaccatatttgaaaatatggagcaaaaggactattaataaacagcaaacatgtttttaaaaatatgctaatgatattttattaaaaagtcatatttacctatgcatattggttatctattgcagggtaacaaattaccttacaattttgtagtttaaaacaacaaacatttattatctcccaatttatgtaggtcagaaatatgggggtgagttagccgagtggtgctgatttagggtctctcatgaatccagccaatatgtcagccaggactgtagtcatgtgaaggcttgaataggggtagaggcttgctttcaagggacctcactcagatggctcttagcagaagacctcagttctttgctagaaatttccatagtcctgcttgaatgttatgatggcatggtaactggtttcttcaggaaatgatccaagagaaagagcaaggaggaagctgtaatgcctagtcttggaagttagatgccatcccttctccacatcctatctgttgaaagtgagtcactaagtccagctcatcctcagagggtgaggtggtggggactcgccctacctcttgaagagaggagtatcaaataatttgttaaattaaaaacacctgccgtgtgatgattttaaataacattgaattatattttacttcacgtatttactgattgctgtctctatggatatttacacttttttgctattacgtgtaatactgtgatgaaaaacctttatttgtatatacattgattcccaagtgtgtaagtgtatttaagggatgaatttctataaatgcaattgctgggtaatgggcatgagtaattttaatagtttttaccaagtcttcattgagcatagggtgtttatagtttgaccagcagtcggtgggtgtttcttcatagtgtctaacatagtgtgttaataaacacttggaaaaaaattaaatatttttataaaaagcaatctcacatcttacaactattagcatctaccaaagaggaggcatggtcacttggatagacattctaactcctcttcttatcagtgaacataagattactctttgctttattagttaatttaattataccaggcatgagagattattaatctttatggaatttaacaagcaagtttaattttataggatttcttatgaagctctttggaatgtgagatagtggtgacagtcatggtaagaaagactagaattggagtaatttattctagaaaacacaaggcaatccttgctgtagagaaaggttgctttcacagctccatttccttttgcatagtaagagggcattacgttgactaacagcagtttcttatcagtgtatgagaagtaagtcctcttattcaaccaatccttggataaatgactaaggatggctgcttcctactgaagagaatgtgggaggaaacattgattgggtggagaatgagaccgcaaggaaatatcaaacaattcctaaattagggagtcatgaattaagacctcacaggagaagaagggtgatgttctttttgagtaaagagagtatgatttacaaggcagcctgggaaagcaagcattggtgggttggtggagaaagtaggccttgtataggcaagactgtagctatggctcctcttcctggctttctgcacctatgtcccaggcaatgcatgagtcatccaacacacggggccataaagcacttaatgaaggtcataccagagcaagccaaccaggacagcaatcagcattgttcatcagctgctccaccagaacaccaagtcgggtgtggtgacacactcagggaaagtgggactgacatattttgtaggaacattctgtttcttacccaggacccattacctgtcttctctttggtaaataatgagacctgtgctttatgacttagaatatttttatttgatttccacaataagaaggtggcaatagataataataacaaaagaaattgtagtttcattttacagataagaaaattgagactcaagagtattacataaattgtttcagctaccacagcaaaaaatggtatggttgggaatcaagctcagggattctcatgctctatttagcaccaccttctcttctgagaagaacttggggatagaataaaaaaataagacactaatgaaatgtttagcacatgtgtcttttgtgaaagggagaaatagagtagtgtgagatttctgtgactcacttgaaaatgacttttaaaaactaatatagaagccaacatcaccctgataccaaagacaaagacacaacaaaagaataaaactacagaccaatatcccttattaacatagattcaaaaattcttgacaaaatactaacaaactgaatccaacagcatgtggaaaagataataacaccatgattagtgagttttattacagatatgcaaggatgattcaacatgcacaattccataaatgtgattcatcacacaaacagaattaaaaacaaaacccatatgatcatatcaatagatgcacaaaaagtatttgataaaatccagcattccttcataaaaaaaaacccttaaaaaccttggcgtagggagaccatacctcaaaataatgaaagccatatatgaaaaacccatagccaaaatcatactgaacagggaaaagttcagtacgattgaaagcattccccctaaatggagaaaagacaaggatgcccattgtcaccactcatattcaatatagtactgggagtcctagctgcagcagtcaggcaatagaagaaaataacaggcatccaaactggaaaaaaggaagtcaaattacctctgttcactgatggtataatcttatacctaggaaactctaaacccttcaaaagactcctagatttaataaatgacttcagtaaagtttcaggacacaaaattaatgtacaaaaattagtagcatttccatacaccagtaacaatcaggctgagaaccaaatcaagaactcaatcccatttacaataaaataaaataaaatacctagtaatacatttgaccaaggaggtcaaggatctctacagacaactataaaacactgatgaaagaaattgtagatgacacaaattggaaaacatcccatgttcaaggattggaggaatcagtatcatcaaaatgaccatactgcccaaagcaatctacagattcagtgcaattgttatcaaattaccaatattattcttcacaggtttagaaaaaacaatcctaaaattcatatggaaccctgaaagagtgtaagtagcccaagtaatccaaagcaaaaagaataaagctggaggtatcacattacctgacttcaaattactctaaaagactatagtaatgcaaacagcacagtactggtatagaaatagacatataaatcggtagaaaagaatagagaactcagaaacatagccaaatacctacaatcaactgattcttgacaaaaatatgcactggtgaaaggactccctattcaataaatggtactgggaaaactgggatgtcatatgcagaagaatgaaatctctcaccatgtacaaaaattaactcaagatggatttaaggcttaaatgtaagacctgaaactataaaattactagaagaaaaatctaggaaacactctctggacattggcctaggcaaagaatttatgaccaagtcctcaaaagaaaccacaacagaaacaaaatcagacaaaaggggacttaattaaactaaaaagcttctgcacagtaaaaaaataaaatagagtaaacagacaaccaacagaatgggttaaaatatttgcaaacagtgtatctgacaaagggctaagatccagaatctataaggaactcaacaggaaaaaaaacacataaccccattaaaaagtgggcaaaggacatgaacaggtatttttccaaaaaaaaggcatacaagtggccaaaaaacatgaaaaaatgctcaacatcactaatcatcagagaaatgcaaattaaaaccacaaatgagatgatatcttacactggtcagaatggctattattgaaaagtcaaaaaacaacacatattggggaggatgcagaaaaaaggaaatgctgatacagttttagtgaggatgtaaattagtacaatctctatagaaaatggtatggagatttctcaaggaactaaaattagaactacccttcaatccagcaattccactactgagtatctacacataaaaaaataaattgttttatcaagaagacacctgcaattgtatttttattgcagcagtgttcacaatagtaaagtcatgaaatcaatccaagtgttcatcaacagatgattggattaaaaatgtagtgtacctatatgccatggaatactactcatccataaaaaacaatgaaatcatattttttagcaacatggatagacctggaggctattttttctgcgtgaaatgacccagaaacagaaagtaaaaaactgcatgttctcacttatacacgagagataaacagtgagtatatatggacatacagagtcatagacactagagactccaaaaggagaaagggttaggggggaggtgaaatactacctattgggtacaatgtacactatttgggtgattggtacactaaaagcccagtcttcaccactatgcatatacatccatgtaacataattgcatttgtactcctaaatctataaaaattaaaatcagtacaaaatatttttaaaaagtgaaaaaaatgctggtaggaatatcatagatcttctagttcaatttatttcctttgtaaatgagaaaactgagaatgagaaagcttaagtaaattttccaaggtagtctagctggttattttcagaatgaagattgcaaaaaagagaattaactagatttaaagtctcctggaagatgctatatcatctatgtaccattcttgctaaaaaatcaaacttaaatctgataaaaactctaaagctaataattaatttacaggaactataagggtagagaaacatgttagcatgcatagagatgtaatcaacaaaattcagattgcaggaaaaatctacagaacaaattctgtttattaaaaaatacataacagatataaaccaattacaagagataaatcttacttgcatcctcaggagagcagaacaaattataaaagtttatcagacaatgaaagaaattttaaaattcactagatatttgatgacagtaaattattataaacatatattaggtatgataatattttgccttttgcaaaatttcttatcttttaaagaaacatactatttttagattaaaagacatgagacctgagatttgtttcaaagtaattcaggggtagggagaaaagtggaccagaataaggacagaatgaattggccatgagctgataattttttaatttagataatggatgcttgggaggcttgttatagtattcattgcatacatttgagcttttccattaaaaatcttactagttatatagtaaatcaaattcaaatctaaaattgttttctcttacattttagagatggcaagaaagaagctgaaaaaatttactactttggagattgtgctcagtgttcttctgcttgtgttgtttatcatcagtattgttctaattgtgcttttagccaaagagtcactgaaatcaacaggtaagaagtaactctggggctctctccatatgttgtttttattagagcaaaccttcaacaatgtcaggaaagtaatgctttcatgctcatgtgtgtatgtgtttgttgcgggggctgttatatgtgtgtgttctatgtgttttggacagctcagtagatattcattgtaggtttaagttctgatactttgatttatcaattaatgcattgcagaattccataattgactttttaaaaatatttgccaaatttccttaaataagtctaattctgctaagaatgataattaacaatacccttatgtgaaaggcaagcgagtatatgagagacttcaagcagtttgtggaaaaatagaaatatagaaataaaaagaaagctagaaagataaaaataaaaaaaactttatttctcagtgtaaactccatcaagttcaagacacttttgtaaaagatgataccagccatttagtccatccataagaactgagggtcctgggaatttaacctttgtaatgcagtcttttttacattattaactgaaaaaaatgaatgccctttatagatttttttttaagattaggaaactaaaagaagtcaaaaggagccaaataggaaccataaggtggatttcccatcaaaactcttgcaaaattgcccttgtttgatgatgaaattagcaggagctttgtggtggtggagaaggactctccgtgaagctttcccgggcatttttctgctaaagctttggcaaactttctcaaagcactctcatgatgagcagatgttactgctctttggccctccagaaagtcaacaaggaaaatgccttgagtatcccaaaaaaccgttatgtgacctttgctcttgactggtctgcttttgctgtgactgggccactttcccctcttgggagccattgctttgtgctttgtcttaaggctcatactggtaaagccatgttccatcacctgctacaactcttggaagaaatatttcagaatcttgatccccacttgtttaaaatttctgtttaaggttctgctcttgtttgcagctgatgtgggtgcaacaattttggtacccgtagagcagaaagtgtgctcaactttcatttttcagtcagaactatataagctgaaccaattgagacatctgtggttttgactattgtttctggtgttatttgtcagtcctcttcattagggcatgaaaaaattaatttttatcttcacaaatggatgtggatggtctgctgctgtgcgcttcatcttcaatattgtattggcccttcttaaaataagttattcctttgtaaactgctgatttctttggggcattgtccccataaactttttgtgagtatcagtgatttcaccatttttccacccaagcttcaccgtgagtttgatgtttgttcttgtttcaattttagcagaatttatgttgctctgataggtgctcttttcaaattgatgtcttatctttcctagtgcctcaagctaagtcctgttcagacatgttgtaacaatctactttgagtttattttagtaccaaaaatatttgaaatttatacatagttttttcataatacatatttttcatggactttctgaagaccctcatctaatcaaactttttttgtttattgaatttttatatcctcaaaaggagctggattatgctgaattatccatggtttcttatctgattcatctaggatcaacttcctaggagaaccaggcaatcaagtgttaacctgtggcttctctgcccctcctaccccatcccttgttacaacaatatctactttttgtagaaaaaagtcccaaagattgctcaactcttaaaattatgtgattctaaagatgtaactaaaaccattatgcagacattggcacaatttgaatttgaaacccccaatgaaaagaaaaccaatcaaaagacactgttttgtcttaatgtcattattaatttattgcagaataccttcaagaaagctcacctccttattttaggatacaataaaaataccttttctaatttactgatttttaaatctgaattcaaagttcactagcccttaggtaagtcctagctgtcagtttttagagtggtggcctccctttacatcttttgtcatataggactttgtatttacagaagaatggcattgctcagaagcattctttgacttggggattggctgttgactgagcaagcaaagctgaggttactataattaggatgacacttgtactgcacatgttctgtgtgcccttgctgctggggttggaagtaaagaatcagatcagaggtcttcagactttactgtaaaggaccagatagtaaatattttagattttgtgggccatacagactctgccataatgacttaattttgccctagtagcacaaagcagctaaaaacaaacgagtttgtaatgtgtataatatgtaatgtgcatgtgtgtaatgttccagtaatactttgtttgtaaaacaggctttgacttaatttggcctgaaggccatagttactgacccctagactaaaggaagggtggtccccaccttcatgagcttctagtctaaaggcggagtccttgctcttatacatactatcttgtaggggagggagttgggagtagaaggagatgatatagagatacacaaaggtaaatacagtcagcaggaacaaagtgacattttataaagtgaatgcataaattttgaggtcatcagagtgaagcctactcagtagtggagttaattggaggtgttgagaactattgaatgtctgtgaaattaaatttgtctaatggtctttttatgtttgcttttggtatagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggtttgagttatgaattttgtttccattttagaatttatgcaacttgatagtttatttttttttgttgttttgttttggttttctttattagtgactctcaagagaggtgtttatgttgcagccattagtggctcaggcaaattaacctgtgtccatgcttgtatgacagtgcagcttcaggaaaggaagacctggaaaattcccttgggttgccagattcagcaaataaaagtgcggttgcccagccaaattcaaatttcagaaaaacaatgaataagcttttagtataagtgtgtcccgtgaaagattttgggcttacttactaaaaacgtatttgtcttttatatggcaacactacatgattactagttctttctgactctgttcatgccctgtatgtctctcctcctttcagaatttccaaagctcatctagaatctgcagtaaaaattcacaaaacattatttaaaataagggcaaagtttcaagagctctgttttggaaggaagaaggtaatgaataccagattaaagacagtgcagacatctgggcatttaccttagcccagtgtttctagattatcggctgaagtccacctgattatgatgattataaagtacttgcccacaccctatgtttgatgtgccaaatttacagaaagttgatgcacatgcatttactttccctgtcatattgtgcaagttactcaatagctcaattgagctgtactcaatagctcactcaagctgtactcaatagctcactcattacttggaagctcacctagattatcacattctcagtatgtcacactactgcaacactccatcttgtcactgggtattggtgcacttcagatacagccatagtaatgtttctttggtgctttattgtaagatcttttgataaatactgtggtatcaagattgaagttcaataaatgaactttggcttttctacatgtcatatctaactgaattactccacggccttggcgtttattaattggcattctccttttttgctcagccagagagaaatactggcactttcaatgattcattttcttgtagaagatacatcttagaacttttgttgtatgttttctgaatcctgagagcggtatgctgatccagattgttgttgagagctgaggctatggataatgatgtgtttgtatggtgttcacattaaagggaatgtagctgaaagaggatggtgggaagaagttatgaacacaacagataggctaggcagaatgttctggtgtcgaaaccattgctatataattttatcattcttatcatctgtcctccaagattatatgtaaaagaactaaaagaataactttctctgcagatgattcttggttgtaaataccattgtttgattctcccagttatgagagggaatccttttccagtacaggaggaagtactgtatcaagccaccctgacaccctgagtactcttgggagactcttctttggagagaatggactctaggagtccccttcatggatcttagaaaaaaagatcactcgattatctaactctagttcggatctttagttctgggcttgaagctggttggagggcatcttcactgaattccttcctatcatatcagctgaactcgttacctcctcaccaaatctgcttttccttctcagctaccagatttctgctagtagttctattaagcttctagttcttgagacagaaacagcagaacttctgcttggctcatcccttctatccctttggccagtattccatgtattttaaaatattttccttaacaataatttccagaagaggcatttcatttccattcttgcagccatccctagatcatcatttcctcatgcttgggttgctccaggtgccccttggcatcccttctgaattccatttctcctatccattccgttacatgtgggattagaatttctcttttttacatccaacttttgttattatttctacccaacttcagtacatatagtggtttattactgtacgttgagccaagttcaaacactgtcttctatcatctaagaccctacctctgtgcctctataggttcacttaggctatacttctatgcagattttaaagacaactgtctacacttattccaaacctttgaattctaaaatcctttccactttcttgatgaagtcttttatccccaattccagaacgcagagttgaaagatcccattgatggcagggagcaggaatatttcatcaaattccagatatccagcttaggaaagaaatgatagttaatacttttaaatcctttgatttttcagggctataaagcactgtgtaaacatgggagggcaggttacgtgcttaaagataaacccgcatgccctaagtaaatgttgcagagtaattaagctgagagaaattcacagttgatttccaaggataacaataacataagtggtaatctcaataatttgagaggttaccatatttcttaaacagaagctttgtcatcttttacagcgaacacacttggtaattgtctatgtattactcatttatttggcttatgatatccttttccaaattccagtttattatcaatatgttggggatcatgttttatgatatagcagcaagggtattgcattttgccaagatcattgtgagtcttcacctttaaattactctgtgtttacacaacatcagttaatagccattatatggtgctaggaagagcagtgagcccagataaaaacttaaagtcttaaaagacttaagtttatgtttggcaccttgaaatgataatgtagccattggtcaagtgaaaggatgtaaggggagccaggttattgagttactcagtcctggctttgcttctggaaagctctttgacttgatcagtaagtcacattttcttataaactgtgaaatccttctaagtaaaatgagacagtatgtgttcagctaaacatactcattaaacgttcgattaaatgactattgaacactatactaacctcaaaatattttagaatagtgatctctaaggttctggcaaatgtttctctgaatattcaccacagtctgatttgggggactagaaagactggattatgggaatggcagaggtggcaactttgttttaaaaagtctttgctgttagacttcactttgaggttaaatgaagtggccagcctaacaagctaaatttcaaaacctgactcaagatgcacatattataaaatagcctacatttaagatatttcacagagtcgagactaattttattcattcgttagttcaaacttgctgcacataaaaacagctagagaacattttgatgaatagagggtgatttgaaattcctttatcatcaagtgctttcaacttctaaaattcctgctctatttgaagatgggatactttgtctcattctactcattttcttcatgtggagactttctggttccaccttttttgttcacaacatcaggttcttttgtgctgctataacataatgcccaagactgagtaatttatcaaacacagaaatttacttatcatagttatggatggagactagaaagaacaagaccaaggtgctggcatcttgtgaggaccttcttgctgcatcctcacatggcagcacgtagacagcaagagacagcccactgtctcctttataagggcacctaattccctttgtctgggaggaggcttcatggcctaatcacctcttaaaggccccactgttaatactaacatactggcaacacgtgaattttggagggggcacattccagccaaagcaccagtctaactgaaattgctctaagtcttctattttcttagacttctgttttcttagggcaagcttctccatttgtctactgaattacaaactatccaaacttagtggtttgcagcaacaattgttttattatatgtagtgattttgtaagtcagagattctgccagggtttggctgaatggttctgttccacatagcatttactgggattacatgatatggtggtatttagttggtggctgatcttgtctggaggtttcaagatgactttactcacatacctggtaccttggtgaaaatggtggtaagactgactgcaccctcttcccctccatgtagtcacggagtctctcttggtactctctccagcagggtagctgaacttcttacatggtggctcagtgctgcaagagacagaggcaaaagcttccagttctcttaaataccacacctaaaccagcatagtatcacttttgatgcattttgttgatcagatcagtctcagggcggcccagcttcaacaggaacagcgacagactccacctcttgacacaaagtgtgttaagagaacttgatggccattttaaacaactgcagaggaatgcttattttttttttcagagtagcataaaggctgctgttaatggtgaaggctgtggtgacctggacaatacagatcagagcaggatggggtggcacaggttagaggagtcagcactgggaatagggtgggtggcagagttgagtgactgaggtctaatgcgaattgtgaggagctcctcctgttccctccagtggcaggaaatggttgatgccactgactcactcaagctgactctgcctcagtctgggatcatgtccttttaaccagcttgcatttgtccttgcaactttgccctctttctttcctgaatgctgtagttgctgaagttttgattttctttttttttaaatcttagatctgctgtttcctaatgccctaatggtttatgcatttcaaggcgcctgtaatcttatcagtaaattattttcaccccatattgtggaaagacatagggaattactttcgagaaagtttctagttgataattgatttcacctttagaataggcttttgagaatagggtggcaatttctcttttttatacaaaaatatgtgagaaagtatttttaaaactaaaaggcccacatgcttactacagaaaatgtgttaggagagaaagtctgtgacagattcctttaggttttttctggttcttctctctacccattacactggtcagcccacaagcacctggggcttctctgttttcctgtaacagtaggaatcatggattatcatttagtggttttcattttactactttctgtttgcttctctttttctctatttcctaggctctgtcccagaaattctgatttaattcttaaggagtggatcccaggcctgcttatttttgtaatttgccaggtgatccaaatgtgcagctaagattaataaccattggtctagagcagcagttttccaacattgttctgtattagcatcacgtagagagctaataaaatccttagcactccagcttcagtgaaggaggataaggcctgagcttttatacttttcctgaattttccaggtgattctgacagggaccatagtttgagaatatagtaaaatgtgtttgacacaatgtgcaaagttgtacatttttcagcagttctgtaggtcgttatgttggaagggactttggcaaaatatggaatgttttcagtctctgtttttatattgttaggcatgattattatagtcttcttggtaatccagtatatgaaagcttgaaaaataatgacacgtttgggacttgataaaagatagggagttgagaaaataggcagttctatattattttctattatttattttcacaatggttttgattttttctatatagcgttaacttctttgaaataattattcataaatatttaagatatacaaaaatatataaccattatccagcttaagaaataaaatattatcagcagagatgaagtcccccacgcatatcccttctgtattattaccttttcctccatcctctttagaagtaaccacacttttgaaattgatatttaccatgcattcctttcaacctttactacctctatatatacttgtaaataatagatatatacagcctataaacaaaatgcatttttgtttatgcgcttaacattgtgagatttaactatgttgatagatatctctagttcatttattttgctataaaactggtacacaattgtataaaattatgtcaattttatggcaaaaataaatcaaaatcattctacagtaaaaaaagtttttcttcaatatattgaagttacatcagtcccattctgaatatttttgtaagtttttttttacttgcatctgtgtgattttagatatatatcttaagtttactagacattatcaaattgatctccaaagtggctgtgccgatttaccatctcactgtcattttctgtatcttctttggaattgacagtcttttaaagttttgccatttgaggattataaaatagtgttctgttgtggtttcagtgctaatttttctgaatactaatattggtgaacatctctcatttagttcttttctgtgaatttttctgtcttgcccgattttatattgagatgtttatcttcttgatgtgtacagtcttcccgtttgttcattcatgtgattctggattcttattcttatcatatatgttgcaaatatttactgttaagaggctttgctcatctattttatactgtcttgatgaacaaaagttttacattttaatagagtcaagcctatcaacaattgtgacttatgttttgataactatgtattcccatattacattgtatctcaaaaacaattccaggaagactaaaagcctaaaggcaaaaaacaaaaagttatagatttaagaagagaaaaaaagaatctaatataataataattgagttattcattctattttttctataaattttcttgaatttctaccgagacaatattttgtctggaagtaatggatgatttggcttcattgttttcagtcttgtacatttttctttcttgtcctcttgaattgttagaacctccaatatatttttaaattataagcaatcatagtgatggatcacttaggtttttttttctgattttaaaaggaatccttttaatatgttaccatttagtaagatacttgttgtacagttttggtggatatccatgatcaaactaaggaagttgcttttcattccaagtttgctaaaaattttattatgatagctgatgaattcaaatgattatatggtatactttttaaaatgagttttttttaatgaatcacacaagtagattttctattattaaaggatctccttatttctggaggaaacaccacttggttattattcgtttaatatgtactgatttctgttattaatcctttgtgtgctttttcttttaggcttttgcatttatgttcatggataagactcggctgtagttatcctttatgtttcatgtttgcttttgacataaagtactttctttgtttcttcccttctctctcttttaagtgttaagaagcattgggaattggaggaggagaggattggggtagagcagagcttgattgactcttaagcagtgtcttcagtatctggcttgtctctatctctgaattctattcactactcctcttcgtgttggcgaaagagcctgtatagctattatataaaaagtaacatatctttccatcctttatgtacattatccatcaattactctgggtgttcttaaaatattctgttatgtactatctcccttaattttaccttgtgattctttaaacttttcttgtatatattttgagtctttattattaggtatatatccagttttagctgtaatatcttgaaactttaatcatcatgtactgactctatgtctctctaataatgaatttttacttaaagtctatttgcctgatattagtatggcttttattttattttattgttttgagatggagtgccactctgtcacccaggctggagtgcagtggcacaatctcggctcgctgcaacctctgcctcctgggttcaagtgagtctcctgcttcagcctcctgagtagctgggactacagccatgaaccaccacagccagctaatttttgtatttttagtagagacggggtttcaccatgttggccaggctggtctcaaactcctgacctcgagtgatctgcctgcctcccaaagtgctgggattacaggcgagagccactgcacccagctggcattctttttacatatttgttttcccctttactttcagggcttttgtgagctttagtttaggatgtgtaaactataagaaacatttagttggacttacttctttaaatgtaatctgactatctttgtcttttaaatatttaaaccatgtgatagttgacatgacacattctttctaaggtctcattttgtgccttctcttcatcctgtttatgtgctagtccccacccctactccttcataaacatgtcttttttcttaattttttggatcgaggatttccacactccccacaactctaacaattttccttcagtactgttttggtagttacacattctatattattttggcagtttctcttaaatttttaattctcatatccaacttaaaggggcattttgtgtcctgggcctaattctttttgtgtgccctaattctattcatgccatcattttctgtagtttctttctaaatctattttcctaggttttacatagtttgctttgtcttattatgtgggtcttgcaccatgtctcttcccacttcttgcaatggctcagctctactgtagaagctggcatttttgagttggccaacaaagactgtttgcattccttgctcttttggccactctgatctttgtcctttccagtttaatggaaaaattattaaactctgggctgtatacaaaaaccatcatgcttaacacccttttcaacacttttttttctttttatgctgaggtttcctctgagtgggttttacaagaacaaagacaaaaccgtggattgaggttgagttcacagtgacacctgatcttacggcagtataaaccacatatggacatcgttgtttatccctcatattggctattagtgtaaaaaatagcatttaattaaatttcattatttgtataactaagcaaaacatttttctgaccatttgcaaggctgtattctcctgaaaatgtgcttagagatactcaacccagagtatagaaaaaaaagaaatggatagtaagagaaccaagttttgttcttgccttctcaatagctgagtaacctttggcaggtcactttacctcggagaagctttaccaccatgggccaaaggtaattcatctgtaaaatgatctggtaggatgtattagttatctattgctgtgtaataaattattccaaaatttaatggcctaatatgacaaatattttctcacagcttctgtagtcagacatctgaccttggcttagctaggtgcctctggctcagtgtctcttggaaggctgcagtcaaagtgtcttccaggactatgggatgatcgttttcaagctcactcatgcaattgttggtaggattcagctcttcaggtgttgttggattgagagcctcagttcattgctggctgctagctggagacctccctcagttccttaccatgtgagcccctccacagtgtgacaacttgcctctcccagaatgaggactccaacagagaaggtgaaagagagcaagcaagacagaaacttcaatctttctgtgatctaatcttgaaagcagcgtctcattgttttctcttgtttctattacttgcaaatcacttgattcagcatgcactcaagaggagagagttctttgtccttttttgtatttaacttggttgcttctcccaaattagttggtgtgagaaagaaactatcttcattttggcttctacttgattcagtcattaattatgttagaaggcacacacctttcttaagtaagaatctatttgggtgtcaagaaagactactttctgcctctggaggagttgagagactgtaaacatgtcatatatctcacatatgtataatccatataaatgtaaggcatatatttaaaagtcaaaacaacattagtttgatttgaaagcttcagaatacagatgattgcaaagtcttattttcatttttaaaagtcaaagccgatataaatgaagctccatttgtaattttggattactggtgatatagctatattattgtttagactatttaaatatatttatgagtttttttttttgtgataaaagttatagaatgcattttgcttcccatactgttacataagaaggacactggtcagaaaaattggttgtgggtagaaactctgccattgcttggtatatggcacaatttatctaaatgtcagtttccttatttgtaaaatgaaattattcataccagagtctcaaattagatgtttcgtgctttataaatgatcatgttctacaactaaatggagcttctttgactaacctcttgtttcaggccacatgtgaccaacgtggctgttgctggaatccccagggagctgtaagtgttccctggtgctactattccaagaatcatagctaccatgtagagggcaaccttgtcaacacaaatgcaggtaagccagagtctgccatgatgcaggaggtccagaccctctggaggttgactctgtatcccccaggggcagcctgcagagttctgctctgtggggccatataaccacatgtgacagaaggtgggcattgctcttaatcgaggactagaatctatgtgggcaccaaggaaaaattattctctgccttgggagttgagagaccatgtcctctttccaacttccccatttatggaccttcatgactgcaataatcattgatcatttttgttttcaagtttatcccttttaaagtgggggatttgaaattggtaacctctcagactacttccaactgtaattttatgttatttttatgaaatggaagtaattccaattttataaacatgttatgaaagttactagtcaatataagtgttcatggagtgaatagcccctcttcttcctcctactctaaaatgcaaagcataggccaggcacagtggctcatgcctgtaatcacagcactttgggaggccgaggtggatagatcacctgagctcaggagtttgagactagcttggccaacatggcgaaaccccatctctactaaaaatataaaaattagccaggtgtagtggcatgtgcctgtagtcccagctactcaggaggctgagccaggagaatcgcctgaacccaggaggcagaggttgcagtgagctgagattgtgccacttcgctccagcctgggtgacagagcgagactccgtctcaaaaaaaaaaaaaaaaatgcagagtataatgatgacaatgatgaccattctaggggatagcagaaggtgacactttagggaggctctcggtataaaggaggaggcatgttcccctttcagatgctcttggcctgatggactgttgcaatgaggtctcaactctcacctggtttaccatttaattagggagatggcatcaatggatataatcacctgtaatgcaatatgaaaataactgagaaggaattatgtatatgtatgtcaggtctgagaatgtaaagggtatctaattaataccgaatgactgatgggcctgtggaatgagtgttaggcttattgggggaggttttcaatcagattttgtagaagagagacatagatttttataaaatgtaatgatgatatctagctccagaatctgccatagatagtatgtgcgtatgatggggtatatatctgtcttttcccttcttttgagaaataaagatttttcatcaatccctttgacatgtatcctaatatatatatatatatattttttttttttttttgagaaggagcctcactctgtcatgcaggctggagctgtggtgcgatctcagctcactgcaacctccacctctggggttgaagcaattctcctgcctacaaagtagctgggattacaggcatgcaccaccatacccggctaatttttgtatttttagtagagatggggtttcaccacgttggtcaggctggtctcgaattcctgaccttgtgatccacctgccttggcctcccaaagtgctgggattacaggtgtgaaccactgcacccagccccgtgtatcataatttttatgtagctattatttgagaatttgcagagtcaactatgaaaaccttttttttctcctatgttaggattcacagcccggttgaaaaatctgccttcttcaccagtgtttggaagcaatgttgacaatgttcttctcacagcagaatatcagacatctaatcgtttccactttaaggttgtaatttgtttatttttttttaagtttttttgagagacttttattccctatcggatgagtgcagttactacaaaatagaaaattttgctactggatgtatttttctatattgctattattaattagcacctgtatgttaaagacatatacagaatagcttcctttactgtaataacttcctgaatatgtattacagtttactagtgagtttggctttcattcatttactctagataacatgtggaatatggtaggaagataaaataaggaagtatcacagctttcaatccatctctgcagatgtgctctgtatgtctctacctaaagactaacttatgcccaaaggtgaaccatttgagtttggtaacataatgagtacatctacctaagatatgaggtcagtttgatcagtgcctgattccagtatcctaagtagggatattgggaagctctgacaagtttttattttggctttccttctatttctatctctgcacagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtaagttttggaaacctatctaaggatcagagtaggaaggttacagggaggtctgtaagcatgaagaagggggtgtttcaacaatattcctgaaggttgtgggcccattattggtgaccagaacctttaccttctaaagtatacatttttttctggctttctttctctttcctctgtttgcacaatcatttttttctctttatttttccctttatttccctccgtctataatatataaccagctgtccaccagtaaatatttactgaacatctcctatcgtaagtatagtgttctggtcatgtagtaggctgtctggtctgggagactaatgcaagaaatttgcacatggtccctttcttcaaggagtccttatctcttgttttccatagaaaaatgtcacaggagggcaaatgggactgaatgaatgggggctattgagtcactgagatataaaggacgcttttctaagcacttacgttctctccaccctgcttgctcacccatccttgtgttctccacctgtgtctaggtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggagtaagctttcaaatgggcccctttccactgaatatcatagtctcattcttaaaggtcacctctagtattacagtgtagtgtttaagagttagagtctagagtgagactacctggctttgaattctagtcttgctattcaccagttacgtggttctgggtgttacctacctctctgtcttcagtttcttatctataaaatggaagtaatatctcaatagggttgtggtgaggatgaaatgaacagatacatgtaatgtatctagaagaatggctgccagaaagaaggtactcaataaatgccaactccttcatattttcctaaccagatatggagaagatattattaatatctgtactctcaacaacagttgattgtgatctccatatttttaggttcacctttaatcactgactcaccaggtttatcatcacaataggataaagtctcagctaaaacaatcattttttgtataaagaatgattgtggtagtgaaagaatagacagagttttgttgttattgttttattttatttccactttgttttgactgctaaaatttgaagtaacattgttttctggatttggcaatactctgttgttcagggcctttctttttcttttcttcttctctctttgtttgagatggggtctcactgtcacccaggctgaagtacagtggcacaaccatgactcactttagcctcaacctctctgggctcaggtaaccctcgtacctcagtgtctggagtagctgagactaaaggtgcgtgtcaccatgcctggccaaatttttgtattttttttgtagagactgtgtttcgccatgttgttcaggctgatctcaaactcctggactcaagcaatcctctggccttggtctcccgtaagtgctgggattacaaatgtgagccactgtgcccagctgggctttcttgactaagcagaattaatggatggaagaaaggagattacagcaataatttattagtcatatatatatatatatacacacacacacacatacatgtttgtgtatatatatctatttagccatagagtctagaaaatataataatttcttgttagaaaaaaccaaggcccagcgaagccaaattaatagctcaaggcaaaagggtttgtaagaacaagaatggcctgaacccgggaggtggaccttgcaatgagccgagatcgcgccactgcactccagcctgggtgacagagcgagactctgtctcaaaaaaaaagaggttgtaagaacagaggaagaatctaatccctactctgtgtaatttttaagcccaggctctgtactgtacatatgcctatcagaaaagcagaaaagctgttaagtcagagcagcttacctaggaatagttggtgacagttgtttcattaaggagcctcagatccttgcttctcaaagtgtgtatgtggcaggggaaccaccctctgagagaggtgggctttcagtcccttcttccatctattgaattaaaatctgcatttagggctgggagcagtggctcacgtctgtaatcccaacagtttgggaggccaaggcgtgtggatcatttgaggtcaggagttcaagatcaacctggtgaaaccctgtctctactaaaaatacaaaaaattagctgggcatggtggtggcgggtgcctgtagtcccagctacttgggaggctgaggcaggagaatggcatgaacccaggaggcagagcttgcagtgaaccgagattgagccgctgcactccagcctgggtgacagagtgagactccatctcaaaaaaataaaataaaataaaaaccgaaacaaaaattagccaggcggtagtggcacacgcctgtaatcctagctactcaggaggctgaggcaggagaattgcttgagcctgggaggtggaggttaccgtgagccaagatcacactactgcactccagtctgggcgacagagtgagaccctgtctggaaaaaaaaaaaaaaaaatctgcatttaactaaaatgcccatgtagtttgcagatacaccaaattttgagaaacacttttccagagcaatagttatcaaatgtgactacatgttgaagttacctggggaagttaaaaaataacagccatgtctgcttctacctctagggattctgttttaattggtctggggtgcagtctaggttgagaactcctgttctggagtctcaaagacaagcctagactagagctccatctagttacctgattcatattaaagcatattgatggagcttttgctgatgaggttaagtcaggttaagacaggcctctttgagagggcagtttttctgaattacattttaaaaattcctatcctcttaccttctaaaaaatatcacagccttcacattccttctagatgaatgataatagctggctcattctgtaagaaaacatgagttcacttggttaacatcaactagatatagaccccatcttttaaaaatgtgtctttatgaccctgaatgtcctgtcaattagttgcatgattaagactgatttcctaaaccaaccccacagtgtgatgctgagacttcttagttgtaaattttggtttttaattctctttctgcagaacggaactaatttgtatggtgcgcagacattcttcttgtgccttgaagatgctagtggattgtcctttggggtgtttctgatgaacagcaatgccatgggtaaaggaatattcatggaaaaaacaagcacaagagtgattttcagtccctttcttacagcactatgataaaaggaatggatccctttaagagtgactgagccatagtgtagggagggccttatagattctctaattgtgctatccctacttcattacctattgatccatggtagccatgagtaggggattttctccaacttatgattttcctgaatctggtggcctctgttggaatattttctattatcaagttaaggagctcacccttccctataatttactctgagatagtttccaccaatgtgttcttctccgtcttcagccctgtagtcagtagatcccagtggcaatgaattgccataggggaagagaagatgtatcagaatctcccaggattgatggtgggcatagggtattgatccataccttttcttaattgagagtcatcgattcaatcagtgctcctcaaagtgtggtccctgaatgggtcacagactgtttcaggtctatagtaagatgagtatagaaatggcgagtaagcaatgctgtagcctccacacgcacacatgaacctttttctagtaattaattttcatattattttatgaaaatatcagcttgcagtgaaatggaaattaaacaaaataaagatctgattctccaccacagatatccgagaagcactctaaatgatctaacatgattctaggacatctaagagatgaatctaagacgattctaatagaatcttagatggtcctaaggtacttaaaataccaaataacctaagaatagactgagataatataatagaaagactgtacagttttagataggtgaaaggaaccagaaaataagatgagtcagacttagtgggaaaggccacaagatcctagatactctgtatgagttgttcctatgaccaaagagtacattgcaatatttcttgaggcattttattcctagatacgaatcaaggtaatgacacaacttttaagaatggtgattggcacatagaagggttttgaatttatgatacaatttctgactttttttttttagtttggcttttgtttgaggtgagattcactgaggttagttacctccatgtctagttgaattatattctcacaataatgacggggtatgtggtgggacatgttctgtggttatgaaagtcagagaggagaaacttttcctctaacctcttagggttaattcttgggaggctgcaaattaaactggcaaaaaggtagattagcaatagaaaagacagaatttatttacacatacaatgcacatacacacagcaattctcagtgatgagtaactcaaagcagagattagaacttggggcttctataccatcttaattaataggtgaaagggaatggggaaagacacttaggagagaacaaatgacattttggaaagataaatgggcccttaggagagtaggtgggaggatgtgatagtcttgtaacactgtttatctgggaatggtgcctgttgtctcagagaagactagaggtactccttggagcagatttatgacaattgctttttattgagttcttttgggaggctctgattttagcacatcagggatttcagtaacttaaatgcctttggtccaaaataatttttttatgtcacagtggcttattctggaccccttcataagcctggctgctttttccccagaacctggggcctggcacaagacactaagacactccagtcagtattattaaaatctgtcacagaaaaaatgccttggctgccatgtgctgtgagggtggacttggatggtcagggttttcacttggtattcaaaatgtgaggcactagggtcaccttgttaatgttcacatggttagtgatcctgtgttattttaaaacttgtagttactattcaagaatcaattctgatttttattttcttcatttttaacctttcaagaggttgtccttcagcctgcgccagccatcacttaccgcaccattgggggcattctcgacttctatgtgttcttgggaaacactccagagcaagttgttcaagaatatctagaggtaaacttaggatgtcaagattatgactcaggaaatcctaaacagcaaatattttaaaaaagtaaaattcatgtgcaagtgtgacccacaaaatctgctgttacaaatttgagatattaaagaacagatttcatatatgcaatggaaacttgctgtatagcatttttatgttataagaaggtgagagaatataaaggtgccccaaacatggccctaccctcaaacatttatgaaggggctggaaaaatagactaacattctaacattaatgaatcagtgcattgggaaatggactatgtttggtgctctgaaagcaatgcttcgaaaaatttttattaaaaacagagtatttgctaattttcacttcacatatttctttcagctcattgggcggccagcccttccctcctactgggcgcttggatttcacctcagtcgttacgaatatggaaccttagacaacatgagggaagtcgtggagagaaatcgcgcagcacagctcccttatgtaagcaaggttttcaacagttctccaaaagtaaagaaattcccttgaagaaaaagaaaaactgtttatattttctctccctgagtttaattgatttatttatttggtaatgaaaggagttttagatattcagaatactagacatttttttttttgttggaccagtaattttttcaaggaaccattgttctttatagtatgaaatagattgggagaccataattatgtgttgggaggcaatctgtttttgtctctatttttcttattatgtattttattagtaaactttttttgtgcttactgtattgactacattttacaggtgtttttatttgagttttcaaggcatttgtctctttagcttgaattgtagcattttaatgcttctcagtatggattttcttgccttacacatgttcttggtttgctttgactcaaaagtgtcatggcagggacttaccataaaagttgtatcatattttcagaaattcctctaagattctggcataagatttcatgtctaaattcttaggttcttaggtttagtgtcaggtcaagaatgatgcagatccccaggctccctacctatgttttaacagatattttaaagaggaattgaggaagtggagtagttctagaccccatgaatttagttcaaactaattatattgctagaacaaccatgagccatctgggttagcatcattttttttcacagatagtaaattgaggctgtcaggggaaatactatgaccaagaccacataggtaattgatgacagaacaaatactgcatgtgactacatggatgtgaaaaataatacaagtttcaggtccatgtgtttttacattgatattttgattactattaaattgggaataagcaaaatttgcctttctctttagagtggtcattttgccattgaagctgagcttcagtagacattttgtaatttgacggaaagatagtccataaatatgatgtgtaaaagaaagtgcttaatggaattgagattcaaaaagcctaggaacactgaggagatgggggaagcagaaagtcagggcagataaagacgtttgggtggatgaattcactctcaatttggctgcgagtcccactactcattctccagcatgacgtgtctttatgcatgtgggggtgggttgggggagggataacagaaaaagtggtaaaagcaggactgagccaaaggacaattaacacagccaccataataatgagtgctacaacgtggtgaactctcgtggcaggcagtgtgctacatgccttctttagttatctcagcaactccattttactattagaattccattggctgggcacagtggctcacacttgtaatcccagcacttgggaagccaaggcaggcagatcacgaggtcaggagttcgagaccagcctggccaacacagtgaaaccccgtctctactaaaaatacaacaacaacaaaaaaattagctgggcatggtggcaggtgcctgtaatcccagctattcgggaagctgagacatgagaatcacttgaaccctggaggtggaggttgcagtgagctgagatcgtgccactgtattccagcctgggcaacagagctagactcagtcttgagggaaaaaaaaggactccatttaagattagaaatcccatttaatattagaaaactaggggaactagttttcaagcccagatctctaacatcatagaggtcatctctttttttatgccattttccttacttatagatagacatttcctttttaagtgatccaggaaatgaaagaattggactgttactgctgcctagtggtgtgagatgtgagagggagtgtttagacagggaattgaacactattacctgagttcagtatacatgtcaaaatctgtcacatttaagtgaatgaaaggatatagtatggacatgtaataaaacatttttgtactttgaatggctaagtttgaatgtacctatgatattggatactattgggagtgaaatttaacaagagatgcaaagggaaaagctcagtagtcttctagaataatcctcttctctcccccactctattccattggagacaaacctaggttgtagagaagggtacattttattctgggcttcactgtttatacaggtaaaattgggatagcataaacaacaaagatgtggggtagaagcgaagtaacaaaataaaatgtggggtagtaaaatgagggagatgtgggagagagacagtctcttcccttctttatcttgtgaatagggtgaaatttaggtcatttcttaggtggatatgtctgattgtcttaggggtttgtcataattggtgttgcttgcttgattggtttttaatgccagagtgccaggcaaggattggatgatgcagttaacctgatggcagggagggggccaagccctagggaaccaaccagtcgtgtgtttttgaaatcaacattggaaaagaagtactcagatgccaggaactgattaagaactctatttagagcccagaacagagttgtttatcctgaataataacagtgaaaatttgatttcattttactatggaaattcctaggtgctaattgtggactttgtatattctttcaggatgttcagcatgctgatattgattatatggatgagagaagggacttcacttatgattcagtggattttaaaggcttccctgaatttgtcaacgagttacacaataatggacagaagcttgtcatcattgtggtatgtactgccctctttccaccaaattaggtatttgctcctccgtatcatacacccatctctcctgctttctcccccagttcccagtctcctttcagtgcctccggtttccagctagtttgttcattgtattcttcctatttttaggatccagccatctccaacaactcttcctcaagtaaaccctatggcccatatgacaggggttcagatatgaagatatgggtgaatagttcagatggagtgactccactcattggggaggtaacttaatgggaaggctggaggctggtggaggggctgcataggggtgtttgaatgtgtctgtgtgtgtgtgtgtgtgtgtgcatgtaattgttttattgtacattttcagtatatttatatatgctggggataaattctcctctgccctttcatgcccaagtgcaagccggccatcgtagctttttgattcccttcacagccaagtaagtccctttaaacaacagctcacacactgagtgtccactttctcacctcccacacactctgcagctgactgtggtctccttccttcccccctcacttccctgataccgctctggcaaaaagcacccgttactttctcactggtaagtccagcggaactgtttcatacctcttcttactcaattttcctgcattatttgacaagtgtacccacttctttctcaaatgtttgtttgtccttgttttttcaggaaggtgttatctgcttgttcacttctaaggcctctgatgaccttttcagagtatagtgtctgggggaaattggataggaaagaaagagagaaaagtaaatgatgttagaatccacagcttatagtggactagctgaaatttacacaatgctcttcccccatttactattcccagaattaagaacaaagaagtgtagagagttaaagatgactaagttagacaatgcctttatccacgaatttattcattaaggacttaaacatttttttaaatgcatatttcttcgagtgaccctggcatttattttaagtattgtgagcaccgcaccttcttaactaaaaaggatatgttcctgggtacctcggttgctgtgatcatattaggaatttctttgcaaagtactttcctttagtctatatttgtttaatttactcttaccagtgtttttctttttctcctgaaggtctggcctggacaaactgtgtttcctgattataccaatcccaactgtgctgtttggtggacaaaggaatttgagctttttcacaatcaagtagagtttgatggaatctggattgtgagttgtttacacttggattattaggtgacaaatattcaaattgtgtatatctgtatctgtatctttgagtcacagagcatagggagaggaggaggagaagaaaggaagtataacaatcactctcaatattcactctcttactatttaaataatcttgctaaaacacatagcttagaataaaaatcaaaatgttagagctgaaaggaaactcagaattttttttcccaagtctagctctttttttttttttttttttttacgaaggaatgagctgaagtcagaataggtcatgtactccttacattgttgcaaagtatacaaattgttcaattgctagttgaagactcttccttttggacatgttgaacaaattgatcagagccaaagtactcaggtgcatgaacaaactatgcctgtggtaaagaaaaatgtctcatatgatgtcagatgaaagaaagtaacctaactgagggttagcaaaatttagggagctccagagttgaaactttttctttttctaagagaactgtagaaaattcaaacaatacagagagttaaaaagataaaagcaaaaatcctcttaaattatagcaactaaagacatttattatcgatacgttggaatgcatctttctagacctttatgtgctctctctctccttttctctccacatatatgtttatatgtatttatatgtatatgtatttacagttatatttcgatatatggaaaaatgtataagttgaaacatgtcatcatataaattgaaacttttttcacctgatatgtttgggaattgttcattttcagcgattatagacatattatttgaagagaggttaagaaccttcttcatgaagccttcagtgggtagacaagacaagaacacctactctattccatttatacaaatacccctttaaaatatctggaataatttatctgattaattaaaaaaagacaccatcacgacatcataagataacatgttactttttcttaatagtttttgctctttgtcttgtaggatatgaatgaagtctccaactttgttgatggttcggtctcaggatgttccacaaacaacctaaataatcccccattcactcccagtaagtcttggtggtcagcagattaaagtagccatatgtatttcatattataaattcataaggacagatctgaaaaatctggcaagggaatttgttcataattgtgcatagaaaaagaaatatgtgggtaatatataaggaaaactaggaaggaaaataaaaacacactatgctttcctaaaacatgcacaaattcaaaaggggcaatctagtacttctacttatactcaaagctatttctagggaagatctagagaggataaagtgtagaggccagaggctagtggtaagtttatgtcattctcaggtatgcacccacaggccagggtttaccagagagacaccaggtaaccagccttggtcatcaggtaagggttatgtctgatgtgtccacagtgtgaagaactgagttacaggatgaaaagacagaactcatgacctgggaggtcaaagtcagtgaacgtgatgatactcagctttgattgaactttggacaacactatctctcagggtgtggccttggcatcatagcatcggccatagtttgaagaatgctagaggttcaaggacagattatatcttgattgagaaaggaaaaaactgctaagatgataataacttatgaaggcttcaatatggtgggaagacaggaaattggggcaggaaggttagaatcaaatgctgaggggcttggatgagaggctaaacagttcatattttactcttttggtgttagaagctacttatcttttagtaatagagaagcatggtagtcagatgattttggaaatatgaacctgacattaatatatagtgtgaactagaaatagatacataggaggtaaataagacatgacgaagctactgcaatagttaagatccacagataatgtggatctcaaacagagtggtgcaatgggagcagagaggaatagatgaatacaggagagactggaaatcattctctacaatatatgatcaggggagagaaggagtcagaaattaatttacactttcattcagtatttccattcttggaccacttaacttagctcagtttggagaattcagattgaacctcaggcctgaatgaatcttcttacttccaagtgtctgcctctaatcacgtgagagctccagtgggaggatgtgtgtgggtcagcagaattcatttatatatcagagaaactactccaagtggatagcattctaatagtaagggagcagtgtgactgtttacaggatgcccacaaaagtgcctgcccagggggctgtcatttcggattgtgatagtcaaggagcagaaaatgtgcaacttaggctctcactgattgatcctgcttttgtttcaggaatcctggatgggtacctgttctgcaagactctctgtatggatgcagtgcagcactggggcaagcagtatgacattcacaatctgtatggctactccatggcggtcgccacagcagagtaaggccactatggctatgacctgctaattattgaatataaagaatatatatatgtttttaattcttggagattatggggctaatgcataaaatttcttaagacaaaacaaagcaaaacaaaacatttaatgatacagaatgctcccaacagggactctaattgtaccgaaagagagttggaagagaatgggttattcacttttaatgtcttttgtattgttgctgtatccccttggctgagacaagctaagatcccacattgactccttaaatctctctcccttgcagagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgagctgctacctcaagctctcttatgaacctgaattcccaggcaacctcattctagaaagttttcaaaccacaaagctcccctctcctgcctgccatggctggggatttaatatcttgagagcatgtgcttcatccacatcagcagggctttgataccatgacattctttcctgtactgccttatgaagacagaacgtgcaactttgatatgtgctggaatatatctttctattaaagtgtaacatactttatacagaaaagtgtatgtatccttaagaacacagctgatgaatttcaccacctgaacacatctgtgtatctagtaccaagatgaagaactataacattgccagcaccctacagtctttggcattttttagttaaatccaacatatttatgaattgaactcctagagtgttcaaggtcttgagcagagtaggcatggtgagagggaaggaaagcataaatatagtaaagatgtaccttctctttgccccaagggtttacagtttagtaagaggagacagatgtgtaaacaaataattgtgacaaactagggtaaaaagaccaacagggacgtatgagttaaatgttatgggagatcccgagaaagggatttatctgacaaaattatgagggacaaaaggaatcaaggcagggagtcaaggacacttcatggaaaagatgacatttgagattaaccttgaaaagtgagtattttttcatctgactaatcaggggggaagttcattttaacactgagaaataaaaatgagcacaaacagtataagggggattatttgatgtatctataaggattggtgtgtgggactggaatgagaaatgatgctaaaaagatgggttggaaccaggttttaaagatctaaaaggttgaacagcaaggaagtcccggagattttttaataggtgagtgacatggtcagacttaggctttagaaaaataatgctgatagtggtgaggtcaaaataataatatcagcagtattactaggtactatgcatccaaaagctctttatgtaaagtgtattacttttattacctcattcatttacgaaatacctgtgtagtaatttagtactcactgacaaaatgaggaaattgaggcacagaagggttaggtaacttactcaaagtcatccagcattcaagagtggacacaggctatgaccaaattttgaccaccctcctagccttctcggtaggaggtttaagcaaggttcagttgggaggtccctggtggaaagcaaaggagggtggttagaaggaagtgaggtatacctgttgtctgtgtgtccttccaggtgggtcctgacatatgtggctttgctttggacacccctgaggagctctgtaggcggtggatgcagttgggtgcattttatccgttttctagaaatcacaatggccaaggctacaaggtaaggctcctaggacatagagtcagaataaatttggcatacattaggactagatctgtctgcatccttgccaagagatctgctgaaccaacctcttacctggtcttcacttactctaatttgcactatcatgtgcaattaaccagaatctgtgctgtatcatcgaaatgcccaacggcctcagcctgttatttactgttgcattcaaggaaatggtgtgtctgtaaaggtctttcatcaaacttctgtacgctttatctacattgtttgcttttaaataagaagcaaacaaggaaatacttcaaaattatttaaattgcagcctcccaagagaggaatcttaaagaatgaggaaggcaggttgaatcgaaaactcaaggagagacacttggtactactcagaagcgaggtttgcaaccttggcctctgtcattcaggagggaaattcttggttgtaatgaatgaggtctggaattctgcaggtgcttctgctatcctgcagccaaaccacaactgcaaactcctatttcctcccaggaccaggatcctgcctcctttggagctgactccctgctgttgaattcctccaggcactaccttaacatccgctatactctattgccctacctatacaccctcttcttccgtgctcacagccgaggggacacggtggccaggccccttttgcatgagtaagttcacctaacctccttaaattttattaatgcatctggaatgacattgactatatcatcaaatatcagagtgaaaactgaaacaattcaggcagttattcatatctatctgtatctatatctgtaatctagctatctatattcattaatctatctatctatctatctaactggaatacctagttggtatttgtaagcatcgcctgttcccttttggtgagagaattagactaaaagtcatgggactacaggtcttttctttgttctgccattcactaactctgtatcttagacaaatcattttttccttagtttcttcagtcttaattcaaaggatttgaaatcttgactgtgatggtctcatctgtaatgcactataatgccagaactatgttcaagctgtaggaatgagcctataatacaaatacaaatgaggatattataaaggatttgtagaatttcagaattcttatttctcaggcaatgaacatctctaatttaattctaaaacaaggcacttaagagcattttcttgtcaaaatacagtcaactcccttatgtgggtgacatatgaggccctcaggcacgtatcaggctattatatattcattattttgggaagtttttgtctgctcatgaaatttcttgttaaaaggcagatattctgaaagagaaaaaagtaaaatgttaaattatctgatattttgtatgatcagatccagtttcttgatagtcagctgaagttatgaaatgtattgattatttaagtttttaattttaaatttttgttggtacatagtagttgcatatatttatggggtatatgagatgttttgatataagtgtgcgatgtgaaataagaacattatgggaatgaggtatccatcccctcgagcatttatcctttgagttataaagaatccaagcacactctttaagttacttttaaatgtacgattaagttattattgactatagtcaccctattttgctatcaaaaggtaggttttattcattctttctaactatttttttttgtatctgttaaccatcttgacctccctcccagcccctcactacccttcccagcctctggtaaccgtccttctactctctgtgtccataagttcttggcttttagatcccacaaataggtgaaaacatgtgatgtttgtctttatatgcctgacttatttcatgtaacgtaatgatctccagttccatccgtgttgatgcgaatgtccggatctcaacttactttttttaaaaaggagggctatggaaaatagaattacagcctgggacctgcctagcatacatactggaatagaaacatctgtttatcctgagggaagaataggagacatgagctggggaaggggaatctgtctaggggtgcagaggggcttgagtaggtgtcacagaataatttggggggtttgcctgggcagacggcctgcatgctttcaacaggttgtgtgtgagtagagctgctacaaatctcattggcagtggctcaaatctcagtgaactgtctctctggttttcaggttctacgaggacaacagcacttgggatgtgcaccaacagttcttatgggggcccggcctcctcatcactccagttctggatgaagtaagtgttcccacagagatacactagagatctctgcatctgtatctgctgccctgcaaactcctctctgcttcttattccaaactcacttctgacatctgtgactgagtcagccttgaagagagtgtgctaggttttgagaagctagacatctggtaactacacatttttctttctagaatttcttttttctcttgatcaagttcccaaccagtttagaagcatctactggaaactctagagttacaagttatgttaggttgttcttgcattgctatacagaaattcctgacactgagtgatttacaaagaaaagagatttcattggctcacagttctgaaagctttacaagaagcatgatgctggtatctgtgcagcttctagggaggcctcaggaagcttacagtcatggaggaaggtgaagaggagcagcgatgtcatatagcaaaagcaggaacaagacggggtggggggagttgccacacacttttttttttttttttttttgagatggagtctcactctgtcacccaggctggagtgcagtggcacaatcccagctcactgcaacctccaactcctgggttcacatgattctcctgcctcagcctcctgagtagctggggttacaggcacctgccaccaagctcggctaattttgtattttttgtagagacggggtttcatgttagccaggctggtctcaaactgctgacctcagatgatccacctgcctcagcctccaaagtgctgagattacaggtgtgagtcaccgcgcttggccgccacacacttttaaacaaccaaatcttacaagaattcactcactatcaccaggacagaaccaagggaatggtgtaaaccattcatgagaaatctgccctcatcatccagtcagctccctccaggccccacctccaacactggggattacatttcaacatgagatttgggcagacaaacatccaaactatatcaagagtggtcctatttgttgttggattctcatagcagatcctgacttgctccatgacgtagaaacaggatggagcagtgacccaacactcactctaaagtcaggctgatcgggatgtgattgttgtctctgccactttgagcctgtgtgatcaggggtgactattgtgctggcttctcatctgcagaggggtaatactactactactaaaaataatggtacccaccatttgggaatgttgggaaaattaaatgaggtaatcatgtaaagctggaatgtttgtcaccacacatgttttattattattttatgattattattattcctaatgtggctacgtttgggatttctctctgggttgccaagttacagtttctattatttgtattagaggagaagcagaagaaaggcataatagcagggcattcctgccctctctgtgtatgattaagaaattccctagagaataaaaagaaatccattttatttccctcaggggacactacatttttttaatttcagggtgcagagaaagtgatggcatatgtgcctgatgctgtctggtatgactacgagactgtaagtagctttgacttttcttctactccttaagactgtagctgcagctgcatagacaagctacctttctggagagagaaacatccatctacatgctgaggagtagtttttagtgttttctgtaatttcatagcagaacctgggtaaagttaacctaaaccgttaacatcagtcatgatgaaatgtgaaaaaataccttcatatactttatttagcaataagataggctgacatagtatctcataaattaatattggaggaactgatggacaatgtgagcttggtcaggaatcagactatctgtttaaaactatcagtttatataatatatcaaatagcctcagcatggcataaattttttcacaaacccccaactggtagcagaacatgttattcttgatttttttccttctgttgtttgattgcctggctagaccataattcagctaattggaaaagggagagagctgtgtatcaccaggcatgtagataatcagtgaagggcaatatgctgtcatgccaatgtgtttgatttatctgcatgcatcaggggagccaagtgagatggaggaagcaaaaagtcgagatggaacttcctggagacaaaattggacttcaccttcgaggaggctacatcttccccacacagcagccaaatacaaccactctggccaggtatagcatggctggagtgtcctttcagaattcatgtccttgcttaaaccctttgaatttcttttcgaaacacactaacagccaggtggtcagcctctttggtttggccacgactgttgcagttttagcaccaaaagtctcttcccttgggaggcttttcaattctgggcaaaccaggtcagttgatccctctgtctgccttggccacactgcatccatgtttctttacccttgactcacttgttctcatttctagagaaccttgactctcctccctcctagaatttcaacttcctatttcttttctcccactaagatttctttcttgtgattcaaaaattaccttatgcaaacctcaaatctccaagtcactgaattttcctttatatgtaattgattccaaaaaaatagattccatctgtactaaagaggtgcacatttatatcttcatggctttgagagtattagcctacttgtctttaatagaccaggagctctttggaagccagaaacctgtcttttcttttgaacctctcttactgctttaattttccaagttgtagactttttatgatactaatggaaaatatccctgaatccaatgccagttggcttcctttttctaactgttcaccttcaagctgttctgcacactgataccaaattaatttttccaaaatgaaaatctcaactggttgctcccaggcttgaagtccaaagtctttcattaatagggtattcaaaaccaatcacaacctggtttcacgttactttaacaactctatctcctgccacaccttcatgtacatacagaccagtcatgccaaaagctttctctttcccagacatacgtatgtattttacaacatttgggcttttgcacttatcctttccaacattctttgcctggtgtattcttaatgatccaaatgaaactttacatttcagcagcaagaaatctttccttaatcttccagcagaggaagcactgccactttcaagtttctggtcattttatatatatattatatatatacgtataatatataatatatatattatatatatacgtataatatataatatatatattatatatatacatatatataatatatatatattatatatatataatataatatatatatattatatatataatataatatatatatattatattatatacatataatatataatatatatacatataatatataacatacaatatataacatataatatatacatataatatataatatataatatatatacatataatatataacatataatatatatacatataatatataatatataacatattatatatacatataatatataacatattatatatacatataatatataacatatattatatatacatataatatataacatatattatatatacatataatatataacatatattatatatacatataatatataacatatattatatatacatataatatataacatatattatatatacatataatatataacatatattatatatacatataatatataacatatattatatatacatataatatataacatataatatataatataacatataatatataatatataatatatattatatacatatatataatatataatatatattatatatacatattatatatataatatatattatatatacatattatatataatatataatatatattatatatacatattatatataatatataatatatattatatatacatattatatataatatataatatatattatatatacatattatatataatatataatatatattatgtataatattatatataatatattacatatattatatatacatataatatctgaatataatatatatattatatatacatatatctaaatataatatatatacatataatatctaaatataatatctaaatataatatctatattatatatacatataatatctaaatataatatctacattatatatacatataatatctaaatataatatctatattatatatacatataatatctaaatataatatatatattatatatacatataatatctaaatataatatatatattatatatacatataatatctaaatataatatatataaaatataaacataatatctaaatataatatctatattatatatacatataatatctaaatataatatatatattatatatacatataatatctaaatataatatatatattatatatacatataatatctaaatataatatctatattatatatacatataatatctaaatataatatatatattatatatacatataatatctaaatataatatatatattatatatacatataatatctaaatataatatatatattatatatacatataatatctaaatataatatatatattatatatacatataatatctaaatataatatctatattatatatacatataatatctaaatataatatctatattatatatacatataatatctaaatataatatctatattatatatacatataatatctaaatataatatatatattatatatacatataatatctaaatataatatatatattatatatacatataatatctaaatataatatgaattatatagatatatctaaatatatatattatatatacatatgatatctaaatatataatatatacatataatatctaatatataatacatatattatatatacatatactatctaatatataatacatatattatatatacatatactatctaatatataatacatatattatatatcatgtaatatgtaatatataatatatacattatatacacatacgacatataatatatacattatatacacatacgacatataatatatacattatatacacatacgacgtataatatatacattatatacacatacgacgtataatatatacattatatacacatacgacgtataatatatacattatatacacatacgacgtataatatatacattatatacacatacgacgtttaatatatacattatatacacatacgacgtataatatatacattatatacacatacgacgtataatatatacattatatacacatacgacgtataatatatacattatatacacatacgacgtataatacattatatacacatacgacgtataatatatacattatatacacatacgacgtataatatgtacattatatacacatacgacgtataatatatacattatatacacatacgacatataatatataatatatacattatatacacatacgacatataatatatacattatatacacatacgacatataatatatacattatatacacatacgacatataatatatactatatataatatacacatacgatatataatatataatatatatataatatacacatacgatatatgatatataatgaatattatatacacatacgatatatgatatataatgaatattatatacacatacgatatatataatgaatattatatacacatacgatatatgatatataatgtatattatatacacttacgatatatgatatataatgtatattatacacttacgatatatgatatataatgtatattatatacacgtgtaatatatgatatataatgtatattatatacacgtgtaatatatgatatataatgtatattatatacacgtgtaatatatgatatataatgtatattatatacacgtgtaatatatgatgtataatgaatattatatacacgtgtaatatatgatgtataatgaatattatatacacgtgtaatatatgatatataatgtatattatatacacgtgtaatatatgatatataatgtatattatatacacgtgtaatatatgatatataatgtatattacatacacgtgtaatatatgatatataatgtatattacatacacgtgtaatatatgatatataatgtatattatatacacgtgtaatatatgatatataatgtatattatatacacgtgtaatatatgatatataatgtatattatatacacgtgtaatatatgatatataatatgtatattgtatacacgtgtaatatatgatatataatatgtatattatatatacgtgtaatatatgatatataatatgtatattatatatacgtgcaatatatgatatataatatgtatattatatatcatatatgtgatatataatatatatattatataacatatatgatatataatatatattatataacatatatgtatataatatatattatatatcatataatatatgatatataatatatattatatatacctataatatatgatatataatatatattatatgtacctataatatatgatatataatatatattatatgtccctataatacatgatatataatatatattatatatccctataatacatgatatattatatatattatatatacctataatacatgatatattatatatacctataatacatgatatattatatatattatatatacatacaatatatgatattatatattacatatacatataatatatgatataatatatattatatatacatacaatatatgaatatataatatatattatatatacatacaatatatgaatatataatatatattatatacatacaatatatgaatatataatatatattatatacatacaatatatgaatatataatatatattatatacatacaatatatgaatatataatatataatatatacatacaatgtatgaatatataatatatatcatatatacatacaatgtatgaatatataatatacatatcgtatatacatacaatgtatgaatatatgatatatattatatatacatacaatatgtaatatatatattatatatacatacaatatgtaatatatatattatgtatacatacaatatgtaatatatatattatgtatacatacaatatgtaatatatattatgtatacatacaatatgtaatatatattatgtatacatacaatatgtaatatatattatgtatacatacaatatgtaatatatattatatatacatacaatatgtaatataatatataatatagaaatttatatgtgtaattatatatttatttttatatttatatatttattatatatttatatattatatatatatttatattatatttttgttttgttttgttttttgctccttagatgattttgtctttcttctttaatactgttagtatttcaagaacagttgtatactctgtgcttgaaaattttattatctgaaatgtttaggggagtctaagtctattgttagttaactttgttgactttctttcatgttgacttattaccttgtgtgcttggtgatcttattttttttaagctgtgataatcttataactgtgggtctcattcctccagagatgatttgccttctcctctgtgtgcaagccaagaattgcttccaactggcattatgttagcttccttcaaggatctcagcttcatgtgggaatcagaggttcacattctctaccttggatcactaggcttagtagcccaattttaaccttgctatgggaatttgccacacggagattctaggttttgcttactaagcccccttttggttttagctcagtgttttgttatcctgttattgttttcatctcttggatatatttcttactttcttgcaaatccaacaatattttaacaggaatatgtgttgtaatttaactaggatcagggaatattttactgggtaagtctccagaagaatatccggtccaccatatttctggaactgtggttctggactcctagaatatcctaacttttgtgttgttttcattgttcgccttcattttttaatgaatgtgcctattttttcctataatatttaaggtcgttcagatcaggggttgtgatttatttatttttgtatctcattgacttcttagaaacgactgctactcagtacatgaatatttaatgaaagcagatgtttttgctgataataaaaactaactttcttgcatagtgaaaggctgaactgtgaaagaatacaatggagaatatgagaccagtgacagaggagaaacaagaagagcaggaaactgggaggttgcttagagcagtgatagaatgaggagagactccaaataaaaatttctctcttctccccctcttcctctctgtccatctactttaccatgtatttgagtaatgttttgtgtttcttattctaaattatagagtagattagaatgatttgtttttctttcaaaacaaactaataaccaataatcagataagttactactaaatagatggaccttattatatgttgttgctttctgagtataaatggtccttaggcaggcgaaaatgtgtcttcctcacagcactggacacttctactgagggcatcattgctaaagtgatataactgaaccagttattgcccaagatttatttctcttctcatactctgtattctaagtagtagttgcagaagcagcttttatttgagttattgcagtgcctctggtgcttaagttcttgcctctaacatagatgttattgttaatgtttggggtatttctatctcttgtgacactgttgatattaaagataggggcgcctgtcaattttgtgtttgtgcctgaagaaaagcagaaccatctgctgctagtaacttttccaatttgaaatttgatggaaatattctcagctcggctggcaaaattctctgactcctgtctttgtgtcttgaatcttgttccccacagtcgaaagaaccctcttggtcttatcattgccctagatgagaacaaagaagcaaaaggagaacttttctgggataatggggaaacgaagggtgagcacttatacgataatgttgctgtttcccaacctgcacctgtgacttatggtccttcactcctgctggtcattcagctgtgggagaaatctcagtaggcacagtagcaagagtcacttaagtattttgtttctggttgcaccattcagaggtagtggtagatgacctacaaaggaaagaaaaatacatttctatctctggcaattctcctattggacagtgatatctataataggctttttatttatttatttatttatttatttatttatttatttatttatttatttattgaggtggagttttgctcttgttgcccaggctggagtgcagtggcgcgatctcggctcactgcaacctctgcctcccaggctcaagtgattcttctgtctcagcctcccgcgtaggactacaggtgcctaccaccatgcctggctaattttttgtatgtttagtagagatgaggtttcaccgtgttagccaggatgatctcgatctcctaaattcgtaatctgcccggctcggccccccaaagtgctgggattacaggcatgagccaccatgcttggccaataggctctctttttattgtcaatgggtgcttagaagagatggtttcaagactgttcccgtaacccaatgttaatgtcttcctcctgaaattcttatgagcaaatgttgatgatatagaaatcatgcccctgccagtgaggcagtgagaatatactttttagcatatttgtggatccagtatactaacaattcctgtgcttcaagtttaggaaatagattcccttgaggcatatgccttggaagcccttggaagggaaactttgcaatgttccagtaggaaagagaaggaaaaacaatggcttggccttggagactcttgtccatctaatccaatgtgtagatttaaatatttattttttaattgcaaaatatttaattggcaaataaagatgaaatatattcaaagtggacaatgtgaggatttaatatatatataggcatagtataatgattaccacagctattttaaggaacagatccatcaccacccatactgtagactggatccccagaacctattcatctaataactaaaaatttgtacccttgaccatcatctccccagtttccacacctgcaggctctaagaacaacagttatactgtctgcttctaggagctcaacttttttaggtttcacatgtaagtgagaccatgcagtacttgactttctgtctctggcttatttcacttagtataacgtcctctagattcatccatgctgttgcaaatggcagaattttcttctttttatgtctgaataatattctattgtatatatataccacaatttctttattcattcatccattgatggacacttaggttattttcatatctttgctactgtgcagaagtaaaattaaaaacttaaatgtaagggttgaaattgtaaagctcctagaagaacacaggaaacaacctccttgacattagtcttggcaatgactttttggatatgataccaaaagcaaaggcaaaatagcaaataataaacaagcatgactacatcaaactaaaaggcttctgcacaggaaaataaataatcaacaaagtgaaaaggcaaactacagaatggataaaaatgtttgcaaaccatgtatctcagaagagattaatataaaaaaataaggaactcatgcaactcagtagcaaaagatcaaatgacccaattaaaaagtgggtgaaggacctgaacagatgtttttccaaggaagacatacaagtggctaactggcatgtgaaaagatgctcaacatcagtaagtgacacaggtatgcaaataaaaaattacagtgagctaccacctcacacctgttagcatggaaataataaaaaagataagagataagtgctggcgaggatgtggagaaaatggaatttttgtagactgttggtgagaatgtaaattgttacaaccgttatggaaaatagtatgcatgttcctcaaaaaattaacagaacttccatacaatcccatgaaatcccacttctgggtgtatatccagaggacatgaaaccagtatctttaagagatacagtcactcccacgttcattacagcattatgtgcaacaaccaagatatagaaacaatctaattatacattgatgaatgaatgaataaagaaatgtgatacacatatacaattgaaaattattcatccataaggaaaaggaaaactgctatgtgtgacctcaaggcatagctgaaaggagtggtagggtgaaatctgttcttctgaggtgggcaggccagaatctgacttgtctttctctcactttcagatactgtggccaataaagtgtatcttttatgtgagttttctgtcactcaagtgagtagcatatttttatgaatcttaggtgtgggctttggactgaccattagcacatctgtgcttgtgtatattgtatatgtgtgattatatttgtaactttatatgcattattggctataggtgagtacatttctatttatgatttcatcgatgttttcaaaaggaggcattaatatagcagctagtgtttctgaacacagtttttaaatgcctgtgtgtttttatgatcgttttaaattagaggattatccaaataatgttgtacttcttcagcacacactagtagagaaagcagagaggcatttatggcagtggggggtatccggtctggaatggaatatttgagtgacttgagaatctgtgtatactcatatacctttatgcatacttggacttaattgttttgcagaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggtaaaaacccattttgttgagatggtacattgagaattctccatagcatcgtgatgttccttcttgccaagtttgcatgggtccctgaaggaccagggcacctttgaggcctgttttggggaagtgagagggctggggaaaaaaatgaggtggccagagctagaatgagttgggtatttttcttcttattcccttctctgcctatcagtgttcccgtctttctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagtttggataggaaacttgtggtcaggttttggaggtcttagttaccaacttgatttaattctcaagcagtctcatattgatccttgaatgaaggctgtgctactgtgtgtgagcattgttgggagtgggagtgggggctggggactagtagaacagggaagtacaagatggtttagattgggaggagactaggagaaggatgataatctttagaatgtgatttttgtactccagacaagtgagaactttaacttgggaagtgttgtttaaagaagtgtcaagataagaaaactatatagaaaaatattaaatatttgaactaatggtattcaaggaaggtttcagaattggagtctttgggcttagagaaatgaacatgctgggatgttagaaatagaaagaaatataatgtttttttcaacttttcaaatttgccgttgctaaaattgaaacccaaagaaatgaaacagaatacctgacttaccctgatgtgattattatgccctgtatgcctgaatcaacatatttcatataacccataaatatgcatacctactatatacccattaaaattaaaaattaaaaaaagaaatcatttgtccaacattctacagaaatgtgggcatgataaccaggtcatatgattcttattgctgtgctctttctaccactccacgccaatgggtgatactggtttgggcattggagagcaagaggatcaactcactttaggatgacatcatgtgtcatctcacagcgagctaagaggagtcagggtagaaaagaataaggggtgatcacaacaggttttatttgacctaactgttttcattatgctaagtacaagattgtgctagaggggagacatttgacctgttgctgctaaatagattctcccaatgtgcagttctcttcttataagctaaagtcatatgttgcttggatgtttgaaagtctggtctaatttctattttttttttatcgaaaaaaaaacctcaggtcttgcaaagcctgtctcctaaagatgaatttccttatgatttccacattcctacaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggtaaccatgctgatggggtttgtgtgcatgagaatctccacacctaatctgtagtttcttaagcatagcagtggtacttacataactacttaaaatccatagaaagaacttcctaagggacaggatctagatgtgacaagtaggtggggacatgtgcgaaacttcttaagatgaatattttgcttggagacaaggaattgaaatttatgttattgccaagtgataagtgatgggctagttttatcgtcatataaaatgactttactaaccctgtttaggttagagaactttaagaccacatgctgtgctgatctatgactttggccttacttttcaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaaggtaaacacagtacatgtatcaggtagtgattagacccttttcagttccattaccttttattggtctggatcacagaaccctaaaataagttaatcatgctacaacagactatatcattatccagagagcattgagaaatcattgagggaacaatgagacctgccctaattttcatttggaaaagattactgtggctactgttaggaaaatggttgggagagcaagagtaggtacggagagacaacttgggaggctaccagttaggcaggtcagtggagggattaggtttggactagacagtggaatgcaggtggagaacagtggacccgtctgaggttgagaaagttgggttacaggatctagtgctcaattgcaagcaggtgacaatggagatggaacatcaagaatgatgaccgtgttggtatcttgcatcttaatatggatggtgctgacattaactcaaataggaatactgaaaaagtttgtgcttgatcaatgtaagatgatatgttcagtttgggatgctgaatttgagatttctgtaaaatggccatcaatatgcagtaatttcatttctttccagaatttaattgcatttaaggactagggatggactagctgtgatgtctatttttctattaaactaagcttctcaaggacaggaatgtgccctttcctgtttgtgcttctgaaatctacagagcctggccgatagtgctgtaatgttattgacagagtaagtgaaagtggtcaggacattgtcacattgcctgaaaggttctttacaatctgacatcaacccgaattctgagttcttgttcatcctctaatgcagggaagaatctcttgtatgtttgtaccctccttgtaacactagcatgttttaggcacctaatgggtttgaagtgaatgaacttccctggagttctagccttaaccattgcctactctacctcttgaccgtagagtaactctttccaaaatatgtgcctctttctggcccactttaattctctctgccttcgtggttgttattcttcaccagaatgacttgatctcctttctttgtttggttaatgactaccaagcttttaatattctagactgtatttctcccgtgagaccgtctcagtctcccagaaacaatgttaggcatttccttccctagaatctcacagcacttctacatagctctcccttagcacacatcacccacgtgttgtgagctgctctctttgacttcttattcgcatgtgaatttcgtaaaaccataacactgccttattgagctcacgtccctagtgtcttgtgcagtgtcaggcaggggatgtagtaggtactcatgaatcagtttagataccactttcagcaaggacattctgattattttaatcaaatagatttcattttggggagacaggtttttttttgaactcataatgattttaagttatttatatatactcatatacccacagaaaataacaagtaacatattcataaataccacactgattccagaatgattttccaagtcagcagcaatgtcccattgagtttattaaggtaatagaggccttaataatgagaaatcacagaaaaatgttaaatgtgacattgttatctgatatattaattaaatctcagatatcataaagaagatagaaacatagcatctgaactttgtgtccaaaaatcaaaaaggttctgctaagggtataggtttcaagagtagtattgttgcctaaaattgatttcctctggcctagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataaatactgaaggagttgaatgtgcctgaggattcatccaacaaatgtttatggggtgccttctctagattaggtgctgctccttatacacagctgaggtttctcttctcatgacaacaaataataagtaaatatcactttgagtgctatgtagaaaatggactgaggggtgcaaggatggaaggcagtgctggtgtggagtggtcccagctgtgatgatgaggggtgcttggatttgtattgtggaggaccactgaaaggaggcagtgacagagggaaacggaagaatgatgaataactcctgggcttttagcgaggatatctgtgatattttaatcaaattgagtttcagttttgtttgggatatgaacagcttcttggtaggaatcaagtgttctgttgtccttgaaaagtcacctgctggaaacagagataaaagctcattttctgtttcaaatctgcgtttttgtgtttcagttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccaggggtaaggacagagcatttgggatctgtgtctctgcttctctccacccacactgctcaggctttgggcttcatcttcccaaactccacttggtcatcacattctgcttttaggcaagtgggccaattctcaggctcctttgtttcatgtgtttagtttatgtgtctagtttcatggagaaaactagagccatgttagcaagcacatttttgttgagtttctttctcaggcataatgtcttttaaactcctactgcttcttcccatgactccccagtacaagaagaattcctatggtgtccacccctactacatggggctggaggaggacggcagtgcccatggagtgctcctgctgaacagcaatgccatgggtaaggccatcagcacctcccttattttggggggataccaatcatgcctgagtcaatttacaatgtgtttagcctaactgttccttgaaggcaaaatcttcattttacgggcactgctgtttattttttctttgtgtttagcctttctgtttatttcaatctaatatcatgtaataagaagatttaacccaactctcattttggtaaaaatcacataagaagggatagtaacaccacatgggtcccaaatatcctggagggcagctcgtgagagccagttatataatttgaattagggtaaaactatgggtcagagaagttagtctgggggtattgagggtgtatggtatgttggaaaattacctatcgggtactctgctcactgtccgggtgagggatccataccctaaacctcagcatcatgcaatattcccatgtaaggaacctgaacaggtatctctttatctaacataaaacttgaaatgtaaaaaataataattttataagagtagaatgataaaatatagtaaagtaccctaaagagaatcaaacccaggaatgggacctgtagacttccattgatcttcttcagttctgtgagtatgatagaaaatgcctgctgttactactctatgatagggagggtgcaggaagatggagaatgtgtggatttcaggggtgattcgtgacatggaaggtgtccgtgaggcttggcatttttctttattttcagatgtgacgttccagcccctgcctgccttgacataccgcaccacagggggagttctggacttttatgtgttcttggggccgactccagagcttgtcacccagcagtacactgaggtagggggaaatccaattgtttatcaagtacttacacagcacattctgggtgccagagtccacattgattagtataactctcagttgacaactggaaatattggtctttcttggagagagattatagaatgagaaaaaataaatacattctaattatcattaaatttatagcctctgtaagcattgcagaatagcagaagttatagtggtactagtggtggtgctggtagtgatagtagtgtgatgttggtgttatttgtggttatatggtgatgatggcagtaggggctgacggtggtgatagtgatgtgggaatggtgataatgatggtggtggtagtagtggtgttggtgatggtgatgatagtggtgggggtggtggtaatgggtgtgttggtgatgatgacggtgatagtggtggtgatggtgacaagggtggggctgacgatggtgtttgtggtagtgatggtgatgatgatggtggtgttggttatggtggtggtggtagtggtggtgacagtgaggtggtgtgaggagtgtgatgttggtgatagtggttgtggtgatagtggtgatggtggggatggtggttggggtggtggtgggggtggtagtggggggtggtggtgacggtagtgaagggtaatgataatggtaatggtggtgggggcacgatcgtggtactgggggtgatggtgaaaatagtgatgatggtggtggtgatgatggtgatgatgaccatggtggtcgtggcagcaacaacagacacttacatactaccaagtgcgcatcactgatttatcacttgctgcatgttagagcatttcacacatattaactcattcatgcatcacagaaacactatcaggcagatgctattattatccgttatttacagatgaagaaactgaagcactaagagattacttaatttttgcccaaggtcacacagctagcaggattggagcctgtatactaagccaggcatatgtctctgattctgggtttcttaaccagttatctacagtgtctctaggaatagcgtaacatcagattttccataatttttaagaaggagctcaagtctagcagaaagctttctctaagtatcctagtggctctatatcctgtcagttttggtctggatttcaattagttagttgtctagcttggggcacagaaaaatattcttattacttgatgtaaaacttcaatgtggtgcctctgttctgaagactaatattttctgtctattttctagttgattggccggcctgtgatggtaccttactggtctttggggttccagctgtgtcgctatggctaccagaatgactctgagatcgccagcttgtatgatgagatggtggctgcccagatcccttatgtacgttctcagtcatggctctggagtttcaaaactaacccaggtgcctctgtgtctgggttcatttgtctaatgtttgttggattccataaagacataaagttctttttcagacaatatcacagttagcctcaccccagcacagtaatataggtaagggcacttgtttccgtcttccagagatgacagctcaagacccagcatgactcgccagagtgggagataggctggctccagggctctttctgctctcccgtgcttccttccatttctttcacttggcttcaaaacatgtagtcaaaaaagtccttggtttcataagaataaagtatatcccacagttcttttacttaattcttgaaaagactaaccacaaatcaatcagacaattgtatatgtgaatacaacctcagttcctgcatcagctctgagctaataacagatggattaaacagatcctgggatgggtttccagaggacatacatatggaaagaaaccttatccttcagtggaggatgggaggggacccagtcatcagagaattgatcccatgaaccatcacatatttaattttatcccacttttctattgtttacagttgttccattagtggaatgtagtgtttccattagtggatagtgaaatgcaatattacagtctcaggaagaatgttgtgtatgattaccctcaagattcggtattccaaagcaactatacatctttgctttgttttgtagtagatttactattagtcctggataattaacagtatttttcctaaacatgaaccactgataccaggggcagcctcttggggtaggtcatcaccatcactcctgatagtggcagtttacaaagcactttccaaaccagtgttttctcttatcctcagaatagccatgctagagacgcattctcatcctagcttgtgctgacttcgattttttttctatcttatcactgaacattttaaaaattaagtgtatttcccagcacctgtacctaacaaatggcagagctgggatttgaatgcatcaacaagaagctgtctggaattccaccatgggtggtggagggttgttctcctataaagcttgggcgtgtacagcagcagcctctcagctccccatgtcctcccgcaggatgtgcagtactcagacatcgactacatggagcggcagctggacttcaccctcagccccaagtttgctgggtttccagctctgatcaatcgcatgaaggctgatgggatgcgggtcatcctcattctggttagtcctgatgtgaatgtgtgcggtctgtttgggagcaggtatgggctttggtggagtcagagttatactttatttccatgttgcaagtagataaattgaagtgcagtaagaaaggtgtatttcccaggactcacagaaactctactgtgcaggtagaagccagcgagttcacccttgaggagttctccttcattctgtttctcctcattctctggctttggttttcccaactgacttatgctttgatttcaggatccagccatttctggcaatgagacacagccttatcctgccttcactcggggcgtggaggatgacgtcttcatcaaatacccaaatgatggagacattgtctggggaaaggtataatcctaagcgatgatccactagtccccagcctgagggtgggtcactgttggtgggtcactgttagtgggtcacacgcctgtgtatgttatttttggccttttctatttgggctctgaggtcagaagctctccttttctcaatcaatatttgttgatacaattaacgacttttaaggtaatgtaacgtgttatggagttcacttttcttttatgtcaatcctatgtgatagtcaaagtattattgctcctaggagcacggtttgtataacaatttattaggaaatactatgtaagggaaattgtctagtgcatcgctactgaacgtatttctctccataggtctggcctgattttcctgatgttgttgtgaatgggtctctagactgggacagccaagtggaggtaaaagggtgtttgtaaatttgggtggagtcagggtttgtaggcaggggcagctgttcctgggattgtggacatgcctgtaccgtggacatgggcttggcaagggagaaacacttaggtgatgtgtcttgggtgtcattctgtatgcctattactttataggtagtcatactttactggccactgggatgtagatatgtattattatccttggaatttaagaccagagagcttaaattatttgttcacagttttaggtgacagagtggtgatttcaattccaaggctgtcagattccaaaggcccaagaaattcccactgggcgatacctcctagcagtgccatcttttctctgaactggcatacttactgttgttgcctcggttatcccttttaaacagtcttcaaccctcgaagactgactaggtcattttctttgtatatctttctttttttccccatgaacaggtgtctccatcttcatacttacgagtcctgccccgagccccaccattccttgggtttctcaactttgcttttacctgtcagtttccagccttattgtaaaacttgctctctcctggggacggtttgttgcttgtaatggatccaagtagtccatgcttctggacctgaatttttttcccgattgactaagcatttcttgcttgaatgaatacatggctccttacaggagagtggagaaagtgaaggcagaagccacaaggcaagagttgaatatggacaggcaaagccagcaccttggagaacggcagaacatttttatgaagttggaaagggtcatccgagcagtacttagggaagttcctacctcacggctggccaggttccctacgtgtaccccgtatgggatagaattctgactcagctgtggctgataatctctttattctaattctccatcccccacccatcccgtcgtttctaaccctgcctgatctggagctctcagtttctggtgaaaggttctctttgtcgggtttcctggttcctacctccatttcctaacaaaaggcatccctggcatgcccacgtctctcaagattctctgtgatgtgacccactgtcttctcacatccttgactgccagacccatataggctgatctgtttctgttttcttatgttcccttttctgccctttttctagacatctgggttcctacctgccctttatctgtggtgtataagaactggagctcccctagaccaagtcctgtttttgttgccttccccaccctcctcaccagcattctttagctctttcactcttacaatggtgtgattatcatagaggaggctatttactgagacaaacaaaggactgtaatgttctataacaaacaacatgagtatattaaaattgaaggacatttacttgctgcttctaagtggtgtgaacccactgttaaacactgagtatgtattttatcccaggttctaagctcagcattgtgggcaatataaatatcactcagaaggatataaaacaaacttcttactctcaaaaatctacaatgtagttaaaaagttgtatcttgaatctttctttcaggttaaggtaaaaacactgcttttattatgtgagggtagaggaaaataaagggaagttgatgcatcctctttaagtcctctcaatttatgttacacacagctgtagttgtcatgtgattctgaaatcgtagaaaacactgaggcgtacttgtctaatatccagaaatgtaatcttattccttcctcccctctctcagtgggaatgacataggagggagtccctgggtgtttcttcctaacctattaccatgcatctcatgtctgcagtctctccctggctttgtctttgaggagtgcataggaaatggcaggactgacgttgagggttgggcatcgagtgcatgaggtcactagttcgggtcattgattgtcatcatccacgtgtataggaagagaacagtttttggatgttttccaaatgctgggaaggtgtgcaaattgcactaatttctcctctcattctacatttctctaagaagttaataacattatttaggccctgttcaggctgtctgtcaccatgcagttgaagtatttgtgtgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtggctcttgtctatctttgtgtgcctaagtatatgtaccactgaccttcaatcaagaggatagtcattgtccaaagaagactttggacatagcagacacttcttcctctcaggagaggaactgccctggtagccctcacaccttctaccagacctgacgctcctactgtaaaacctgtgaggcgggaccaggcgtggtggttcacgcctgtaatcccagcactttgggaggctgaggtgggcagatcacctgaggttgggagtttgagaccagcctgaccaacatggagaaactccgtctctactaaaaatacaaaattagttgggtgtggtggcacatgcctataatcccagctatttgggtagctgagggaggagaatcgcttgaacataggaggcagagtttgcagtgagccaggatcgcaccattgcactccagcctgggaaacaagcataactccatctcaaagaatgaaaaacaaaaccaaaaaaaaaacctgggaggcaatttactaggaatttctggaaatttgattgcctcacagccaccctgaaagagatctatttttttacccctctagccagtcgttctgtaggagtgaattaatctttctagccagttctcaccaggatttgatgaagctcccagggctggcatctacagagattactggatgttgaacaatttattcactacttccttggctcagaattggcaggacgtaattatcttaaaaagtgaggtatgtctgtgtttggcatttctaggatatgaatgaaccatcaagcttcgtgaatggggcagtttctccaggctgcagggacgcctctctgaaccaccctccctacatgccacgtaagaagccttggcctccttgactggcagagccatgactggaaggattacactggaggagcccgaggccaggggcagccccacagctgagggcacatcctcatggctgctgtggtttactggggaccagagacaaaagctctgcacgtgctttacccagccgggcatgggcaagtgactagactcattgagcaaatttcttgaaatttgtccagaaagcacttagcagagctcatggcacaaagggttctcacagctgagtttcttagtttttaggcttgtgtgaattccatcacaggaatttcttgtgtcatcagtgagtggaaattactggcttccccttatcatggagctgatggactttggagttacacttgggttcatatcttggctccagaaattgttctctctaggagttttgtgacttttcacagattatgtgatatttccaaatctcagtttgctaaattgtaaaagacggataatgagatcttcttcatagaattatggaaataattggaagtcaaaagcctaaatcagagcccgtcatgtagtgtttgacagctgtacgttcttcctgacacctctgcttccttcagtgaacttgatgttggaaacacagcaggcgccaatgcagctcagagctgggggcgctgtgctcatgtctctggggagatggagagcgacacaggcaggactgaagttagtcttaagatccagggcccagtcccttgaagagaagtcagggagaaacagaatcagggctgggtttcacctcgccagttcttcctcctcagatttggagtccagggacaggggcctgagcagcaagaccctttgtatggagagtcagcagatcctcccagacggctccctggtgcagcactacaacgtgcacaacctgtatgggtggtcccagaccagacccacatacgagtgagtctccgtctcccttctccagctgtcacaacctatagcgattgccagtgactgacatagctaccctagttttcctttcattccatttctaaggattaagaagattctcataactctgtaatgattcttatttattaaacaaatgctcattgacatggagccaggccctgtgattaaaagtaggaggacagatttaaataaggcatggtcccaccagtgaaaaacttaatgatcctagtgggaaagactcacatggagacaccataatggtcacacagggcagccagtggaacaatagctttagttacaggaggtgaagggaacacagaggactgggcatctctcccgttcatttcaaagtgaatcatctttggagatgtttgtatttttggccattcttggtggagggtaactggtattgtactgaattagcacagtcctgctttgcaagctcaatgaatagtatgaattcttctaagaggatcttataaccttcactgtgttccttctcaaatatagaaaactaagtattgaggaaaccattagcaagacatagtaattccttagtattttgggagtactccagtgaggctgctacagtgaagttctttgtaaagcactgtgagaacacgtgactcattatctccatcatctgggatcagtggaactcctattacagctcagagtcccatgttccctccagtcacgcagcaaacattgactaggctcaagggctctgggagcagaagctctatggcctttactccctggctgttgcctcagttcacctcctgttcccttccaagcagagccgtgcaggaggtgacgggacagcgaggggtcgtcatcacccgctccacatttccctcttctggccgctgggcaggacattggctgggagacaacacggccgcatgggatcagctgaagaagtctatcattggtgcgtgggtccttccccagggcctttgccgacagggcagggagttgggatccttagggaagaggtgaggaggcagatcatgagagcctggtgtgacacagctgtgcttctcgttgcaggcatgatggagttcagcctctttggcatatcctatgtgagtgtccttgggatcctcctaagcaccaagaaggtggggacatctttcagaaatcatcagcaggctccttttatttcctcttgtttcagacgggagcagatatctgtgggttctttcaagacgctgagtacgagatgtgtgttcgctggatgcagctgggggccttttaccccttctcaagaaaccacaataccattgggaccagggtaggacagtggcttctacctccactgttttatgtcacttgaaagacagtctccatttctgtgctaaaagtaatgcagtctctatttcctgggatatctttaaaaaaaggtgtttttttttgttttgttttgttttgtttttttttttgaaacagggatttactctgttggccaggctgaatcgtgcagtgtcccaatcatggctgactgcagcctccacctctggggctaaagcgattgtcccacgtcagccttctgaatagctgggataaaggcacatcccagcgtggctacctaatttttgattttttgtagaaatgggatcttgccatatttcacaggatggtctcgaactcctgggctcaagcgatccactcgacagcctccaaaagtgctgggattacaggcgtgagccactgcacccttaaaaattgtgaagacctggtgtctcaatgaaccatattcctcattgtgctttagattattatttttttcctgtatttcaggcagaattttaccaaatgttccaaaaagaatgtcttacagtgaaattttatcagctgtcttaggagagctttggtgactctttccggtctattaagaatattctctgggcctcatgtatagttttcttttgtttagctgtgagtgatcttcaattggagtatgcttttagtgaccttcttaaatcccctagaaattccagggcgagctcccaacactgttctctttctcctttagagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtgagtgtccagcagggatcccgatgactaatggatgacttattgcattctatgtggtagcagttgatatacacaacgcttccaaattaaagacatgatggccttttgacatgagctcttcagacacaaagtatacctgattactgtctttagcacagtgttatacataccgtaggtcataaaaaaagggtatttattgaatgacgaaaattgaaatgatgcagtacagcatagaatagtttcattctaatttggttgtgcaaaggcctatcttatgtagcagttttgttatatggacccaggtcacaaaagaaggatttcagcaagagaattgagggacgagggccatcctcacatttaaaatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggctgtgcaaaggcctatctatcttttgtagcagtttggttatatgtagccagatcacaggagaaggatttcaggaagagatttgagggaaaagggccatccttgcatttgaagtttgccatggttgagaaatggggcaagtattttacaagagagaatacatctacatcccagcatttctgaagtttgaggcacatcccatggggaaagcagaggctgggtgctcctgatgaagctaggcctaggaaaaaggcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgtgtgagtatggaggcctccgatgaggggaggatcccagctgtgaggcttggggaaaaggacgaggagaagaggcctgagctggtgggggtcctaagacatggtttcttattctacctgtgtctcttcctctctttctgagctgaagtccatcacttaggtgttcttggcctcagctccttcatctttaaaatgagcctaacaattctggttcataggatgatcaagaagaaaacacctcatggtatattcaatgacacaatcgtttcttcgttaactaaaataaggaatagaagatcagatgggggcagtattgtaaagaattcataacagtcctctagcactattacaacttttcagaaggattgcttggcaatgtgtgtgtacttgtattgctgctggctaacccttcccttcctctgcaggagctcctcccagcagtaaaagccatttctttacttctattgttgattaggcttctgattaaaataccagttaattgcaccttcccaaaatctttttttttttttttttgagacagagtctcactctgtcatccaggctggagtgcagtggtgctatgtcagctcagtgcaacctctgcctcccaggttcaagtgattctcctgcctcaacctgccgagtagctaggactacaggcacgtgccaccaggcccggccaatttaaatttttttttttatttttagtagaaacagcattccaccatgttagtcaggatggtcttgatctcctgacctcatgatccgcctgactcggcctcccaaagtgctgagatgacagacgtgagccaccgtgtccagcccgcaaatcttatggtacccacagaatttttttctgccccagacacaacctcagttgtttgtctctttaagagggaatggcgtaagcctatttctataagcaaatagtgaatttttttttttcccgaagtcctgggtaccaaagtgctttatgaaagccacttgttttggggtagacagatctctcctgtttgaaaaaggaaaagggatggaaggtttcctcaataggtgacctcctgggacatgaggcaagtgggcccaaggccatcacaattatttaacctctttcctaagtattttggtttctctgtcctggaaaatggtgccactgccacaccttgtttatgtttcattttagaatgccagaaatgtcactgcatatttccctagagcccgctggtatgattactacacggtaagtttttctgaatgtttatacaacacgggaaaatggtagagagtacaaaggctttagatctgatagaccttaggtcaaatgctggctctgtaacccacctgctgtgtggtcttagagaagccactttaacccttgtaacctcggttttctcacctccaagtggagtaagaccacttccctcatagaactgttgtgaaatgacacataaagcatctcactcaggtttttcgtgggtgttctctttgtgttaatttttaatattttcttatatcactgctatttacaatgttttgtaaaggcagatgcttttgagattgtgttgcaaactatagtttttgtttttaatgtttatatctttacctgctgtaagtttgtaagcatagaggcctttttgtctctgtctttttattaaatatctccttccatagcatagatgctcaaagaagggcactgcacataattacctaaggtaagcaagtgattaggcaatgtgcaaaacacacacagaggtatgggacccaacccttgtgagtctaagcagtgcaagtgcatttagaaatgaggaagcaatgaagagctccttgccgcatagtttctgtgctattatgttccccaaagacttatctgggaagccagggtcttcccgggcagctctggggtggtgggctcttgctgggaccctgacaagtcagaccctgattcttggggaagaatcaaagaaggcatttccttggtctctaatggggcctcttctgactttctgaggagaacatcgttgagggctggaaatacagcaaaggggtacaagcagggatacaggaagcagagcatgtgctggcccctttcatccaaggggattgcagtgagattaggtgaaaactggagaaggatgtgcattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaacagaagatgtctttggttgaagaggaaaagacaaaagaaatcatggagcaagctatttagaaaaagatgaaattttgatgtttaattaaaatgaagatgaatttcatagttaatattaatgaagaagtgtcaccttaattaatcttcccaagtttgggtaactattactcattctagagcacaagctggcaaaaactatggcccacagccaaatctggttgttagctgatttgcaaataaagttttattggaacacagccatgcatatttgttcgcttgttgtcaacaataactgcttcttacctgtaaagtagcagctctgaaatgagaggattttgcctaccaggggacatttggcaatgcctggagatatttttggttgtcacaacagagtgggggtgaggaggtgatgcggctgacatccgaggattctgctaaatatcaaaaggcacaggatagccccatcgccagagaattgtctggccccaaatctcaatagtgctgagactgaaaagccctgctctagttgagaacatgtaggatggaagcatggtcccttaggttctgatacaggtgagagagtagcacctcttcctgtcacacatcaggcaaatgtagtttgtacagtggaagcaaaggcaagagaccctaacaagatattatagcagccttgcaagatttcttgcagcactgggtgaatgcagaatgggtaatggcaggtatgttgcaaagggtgatgagcaggcataagttcagaagggaggatgagatgtctggcaggatgcattgttcagggaggggcctgtcctctccttagtcatctcttaccttcttctgcctccagggtgtggatattaatgcaagaggagagtggaagaccttgccagcccctcttgaccacattaatcttcatgtccgtgggggctacatcctgccctggcaagagcctgcactgaacacccacttaaggtaagtgacaggactcaggttttcctttacatgtcagttagctcaacaatttgtaatgaagtccaccaaaatgtaagcatcactctcaaacccacatgcaattctactcaacacttgttttttctttgtttgcttgtttgtattttaacctttttcagactctatactcttcgactaattattaacagctcttttatgtctaagtgggtgagttgataggtctaagagtgtcatctttcaatctcacaattgaaatggaagtcaaaataggagccaccacgattcataatagttttagtatactattgggtctgattgaatatttcctaataaaactattgctgaaaaattgtttattcctctacaagatgttaaaattctagatcaaagtctatgtataaattaaccatagctaacatccagtgagtgcttgccctgtgcctagaactatatgaatatgggcatttccatgtggaaattatctattttttcttagcaaaaggaaaacataaattctgtgaggttagtactgttaccaccatttcatagatgagcaaaaaggctaagtgatttgctcagagtcacacagctactaagtacatgaatgcggactaaaattcacatctctctggtatcaatactaacattcttagactccctattcatttgattctaaagatttaaataaaaatgaagaacttaggacatttgaaaatagaactccctgtatatgtttcagatattaggtcacgaaaacagattttcagcatcaggattttcctttcaaaaggaaaagaaagaacccagttagtctggttgtcattattttaagagccttaaagcagaatcctcttgattcattcactaattcatttgttcatgatatgaagtcatagagccagacagagacagaattagaactaagacacaagtctcttgaattctagtatgcagtctttatcccccaaagcacttccctttgctgctttatgtttgtatgtaaagtcttggtttgtggctgtggctttacttttagctaatgcctctctgcctgctcactgcagccgccagaaattcatgggcttcaaaattgccttggatgatgaaggaactgctgggggctggctcttctgggatgatgggcaaagcattggtgagtagaggttgcctgagattcatgctgatggcactgactacattcctggattatcttacaggcctgctttcaccttttccctattataacaattttgcattttaaaatataatcatttgttaattcaagggtataatccatattggacatgatctttattcctcatgtaaatgaagctcagttctgaatcacctcccattatgcaacctttgtaatccactatagaaggtagcaatatgggagccatggggaaagtttatttgtagccagcggagataaactttcataggatttatggtcaaggacacattcccgaattacatggtttactgtcccagtaagaggggtaatacctctatccgttgtattatttatgggatattttctattaggagtttataggaattggtaaactctcaggaggattgctcaagaaattattagctatttctagacaagtgctatccaatagaactttctgcagtgatgacaatgttctatatcttctgctgttcaatattgtatctagtaggcatatgaggctatcgagcatttgaaatgtgtgacaagtgcatctgaagaattatatttttaattttattcaatcttaacaagcttaaatttaaacgtgttacattttactagtgactgctatcttagacagcacagttctaagggatagccagtggcaactgactgagtggtgagtcatttagaaaagggccagcacagtcgagctcagtgcctcacgcctgtaatcccagcactttgagaggccgaggcagccggatcacctgaggttgggagttcgagatcagcctgaccaacatgcagaaaccccctctctactaaaaatacaaaaaaattagctgggcatggtggcacatgcctgtaatcccagctacttgggaggctgaggtaggagaattgcttgtacccgggaggcggaggttgcagtgagccgagatcatgccattgcactccagcctgggcaacaagagcgaaactctgtctcaaaaaaaaaaaagaaagaaagaaagaaaagaaaagtgaaagaaaaagaaaggggccagcacacaggaaagagtgtgacagccacgagggcagggtgtaggatgggaatacttgaaaccaagctattgactagttcaccttcaccggctgtgctgaacttcatattcttcctaggcctgtggcacacatttaggataaaggacaaagaaggcttttctttgatcatctttgttctctggagatcacatttttaaatttgcctaatacctcaagataaacccaccaagacaccagtgttggtgtttgcatatgtatatgcatataaatgtgtgtgtggagatgtgtacatacagcaaaagaaacctggaaattctgagctggttaggaagatgctgggatggtagaccacaaggaagagaagtgacttaaaaatggtgtcaggaaactgtgttatatgaagtgactctgtcagacagatgtgtctatacacattcatttcaagcattttgtgtaaactgagtgtgggtgcagggtttgattagtctccataaagagcacttacattttaaaatagaacactcaaaagacagaaataaaaacaaagataagccttactctctcaaacaagacaagtaggcaattagaacagcatttatatattctatagcatagagttctacagcacaggtccaggccatgtttatcttgttttttgtttgcagatacctatgggaaaggactctattacttggccagcttttctgccagccaggtgagtgtgattgatatgaagtgagaatagggttccactggcttaggagggtgctgaatatcgtaagggcataaaataccacctagaatttcttcattgctcatcttgctaattcacattcttctacttctctagacttccggtggaaatttactatgctcccaggaggctttctgcaattaaacctatccacatctcatcagtaatgatcattattctagtttaccatgttacaggtggacgggcagtttctgttatctagcccttgttcctgagttgccttggaatggtctgcacattttgggattcctccacctgtagaatataagtatcttaacagctgagactttttgtctcctgtagagttcagggcagtgcgaaagaccctgtagctgcttgtcaatgcaaagtggatgggagttggcaataggccatagagtgatgaaatcatgatttccatgatccaaagttacaagatggtgactctgaagttgtcttactttatgacctacatttgtgcctaaaaagaggttagaaaaatttgaactaattctgctattatatttttcttttatctccaattcaacagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtttgtgaccagcaaaaagtgcgaatggtattctccacccttaatatgcctagtgcagtgcctgactgcttcccttccaaatgatgccctctcctgccaggccctccgggaatccctgagttttccatgtgttaggaatggaccacgtggagatgaatgaaaaatcatggtttatcatcatttggaatccatggcctggattcttactttccatgtttgtcttcttgtctgcaaacctatgtaaaactttgtcttgactccctcacctctgcctcagagatcaacttcccaaacaggttggaactatcatattttatcaaatatgataccatcagtgaaaattgcttcattatttcatgtgccacaaagaaagaaaaaaggatgacaaaactatgatagaatgcttccttatcactcaattttttttttttttttgagacggagtctcactctgttgcccaggctggagtgcagtggcatgtgatctcagctcactgcaagctctgcctcccaggttcatgccattcttctgcctcccaagtagctgtgactgcaggcgtctgccactatgcccggctaattttttgtatttttagtagagacaggttttcactgtgttagccaggatggtctcgatctcctgaccctgtgatccgcctgccttggcctcccaaagtgctgagattacaggcgtgagccactgtgcccagcctcagatttttataataaacttatagaaagtttttgaaacttctttagccataaagttttacctatatatttcaatattgtaagtgataatatggaggaaaatgttgagtggagatacattgatgattctgcctcaacgtaatttaaaagaggtagaccctaaatgtgaagaagcactagaaatagcttaaccaacttgtatcgtatttaaattgtactatttaaattcatattaaactgttttattatttagtttattgtatttattattatttagaagaaaaatatgtgttacaaattggttaagatatttcctctgtactgcaaaaggtgttggtgattcagcattttataaaaattcttccactagtgtctatgaagtttttttcctgagccactaacacactttatatacattttcatcctagtgctttcttgatcttactaaatattccttcctgtaataatccttaaatgttttcagcccatccattcataacacagtaatagcaatgaagcttacacaggcacagacaataacaattatgccatgagtgctgcttggctcacagtaattctatggttgtcgattacaagacacgctcttgtcagatgaatgttaaatatgtgaaaaatctgtaccttgggattaatgctgtgtagtggtcctgacacttatcatcccgatggtaaatgaaactttcttccttgtgtgcttacttattattttttttcctgaacttttttctttcataatccttcctgatgattaagcctgaaacaaaagttttctttcagttttgcattctttacagttatttcctcatacttgtggttttcttgtcaacaacttccccaactataccataaaggactttgcccaatcctgttgctgaccagctcagggacagacatgcaagctgatgagggcacatgcagtgaaagcttcttgacagcatctgcctaggaagaagcaggaatagtggactcttgctgggcaaacactggggtgctatagtggaataggagaaggaggaaacagaaggatggtgccaaggaaaatcaacacctcagtagaatggaaaagagggcattctctccagtttgtgcagttgtttctcttcagcggttgcatattgaacattttttttttttttgactgagtctcactctgttgcctaggctgaagtacactggtgcaatcttagctcactgcagtctccgcctcccaagttcaagtgattctcctggcttagcctccctagtagctgggattacaggcacctgccaccacgcctggctaatttttgtatttttattagagctggggtttcaccatgttggccaggctggtctcaaactcctgacctcaaatgatccacccacctgggcctcccggagtgttgggattaccggcgtgagccaccgcacccggcccatattgaattatttaaaggcccatctctaccactgaataatctttgtactctaaaaaattagaaaacacccttctcatctgaaactttgaaggcagtcttttaactagacaatacaatgtagaagtattagggggttatttggactggatacttgcacctgatttatttgcatgcaggaaatttcaacaccggatgcccaattcttttcctttggttcctaacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtga

SEQ ID NO: 2121 - DNA, 171024 bp, Homo sapiens
catggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 2122 - DNA, 184281 bp, Homo sapiens
aatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 2123 - DNA, 190570 bp, Homo sapiens
gatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattaaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttgtaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 2124 - DNA, 164574 bp, Homo sapiens
tctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 2125 - DNA, 177962 bp, Homo sapiens
aatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 2126 - DNA, 211148 bp, Homo sapiens
aatgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaatagttaagtatgaattatgtgattcataattagacttttccagttttgtggttttgtggttaaaacggtaagatttttgttgctaatttttgaaccaaatcagcagtaagttatgatatccacacttgtaattttgttttgttattaggtgcagtagtagaattattttattgctaaatgcctgggtataagacaaatattttttcttagatgaattgcattatttagagaatctgacttcgacttgttttatacttatccctatacaatgcttcttcaatatcttttgccacttttcatttggacttcctactacctgttagtacaaatgttacttgctcattttatgagttcacctaatgcttataactccctattgattatgcttttccaccttcagtttcaaaaattagatcattacacctgttgtcttttatggaacctcttttattctcttattcacttgtttggagtctcaatccttattttttacttgaatatgattcattttaggccttgtgctctaatttggcaataccgtttattgtttcttgatttcccagttgggaaaaaaatcgagaataacaattgcatttagaattgcatctttgttcatctttagtttatcactactttatttaatactactttaataatactactgtattatatgttaaaatttattactaataactaaaatatcaatatgaagtgaaaatttaatagttgtatagtatatttatatattcattttaaaagaatgttttaaatcttgttaaaaataattttcaatctgaacaatatcttgaaaataattatggtatctaattttaaaactatccctactagcaaaactttttattcattagtgtcttttgcataccatactaaggatgctaatatgaaataagtttgataagccaatgttataatgttattactggttaacttctctgaatagcatcctgcctattaatgtgtgccatgcaataagtagaaaactccaaataaccagaaccaaatgaaattgaaggtagacttttttctaatcactacccctacatatttggttatctcctctagcaattagttggactcccatttaagtttccctaccactggagagaaatagtaaccaactgaaacctggttaatactcattgacagtgtgggaggtctaacacgtaaaatagatatttttcttgactcctctccttcccctcacttccattttctttatttccttttttggcactatcctttgttgctcccttgtccatgaagtagtagccatagtgtgtccatctcaggtcagtattttaaaaatttagttctgttatcagcttcttgaatataatagagtcagccaaagtacttgtcttcccagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaagaaaatgtattgtggtttatttattgggaagtcttcattccccattaatacccaggatgattcaaagatcatgattaccaagaattagaataaaaattaagctaaaacccaagttttcaacattgaacttgaaatacatcttaattggggaaatgtctagagactttttttgtatctttagaaaatcatagaggctattgaaacaccacattttcccaactagatatgcgatcaccttaaattaatgcattttattaggcaatggaaggaagcaaacattttctgcagggtaaatatttaggaaatattaggtaagtccctctgagctattaaacaattaagatacaactattccctttaaaatatatattccaaaaaaggacacacatactcaaatgcttataagagataaattaatgtaataaatggcccacgcgattccaccctggtgctgcagtttgtaaaagaagaaaaaatacctgttcaattggtttgatcatgacattcttcatgggtcagggaagttttaagtggttataaaatggggtaaattggctttagaagagtttagaaatgatgtggattacttatagacaggacaaaatgaacatgcttgtttattaaaaaaagctattggaagcaggaaatattcagtttggctaaaatatataagcactataggagaaaatagaagcttaggcacattacatactggagaacaagcaagtacttataaactgtaagagtcaaaatgagaataccagcgtttctcatgggagcaaatgagttccaatgaataaaattatttggaatgcttttccatgcaagctatttgctataacttcctgcttccttgcactttcagccctgacatgactcaaggaagacatctaattaaatgctgatggtctttgatccttttataaaacatctgcaaatttccctgtcaatagcttgttcttggcaccagaagttccctagagaccagtcccctcaagtcaacaacaccagaaatactagggtgaagagggtgttatcattaataaaaaaaaaccctggaattcttgggaacacaggaatctgtaatgaatttttctaatcaacagtttacagttacatgtttacaaagtgtatagttaggtctctgtaatacttaaaacctgtgttgaaaaaattatttctactgaagtaaaagttgcccctatggcgaaactaaggaccacactcaatcaatcagtggtacaatgtgtaccacagtagtacaaaatgtattcctattctccgaaacgactgaaataataaataaaaccaagtagtttacagtagagtgtgtgggggtttccacaattgctacttacggtttggagccacatgatgtcgctctttaccacaaaatacatgagagaaggaggaagaagggaaaattccttctattcttactggaaggaaccatatacactctttggagtctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataacatccttttgtttaattttcgtattgtttttctctatcaacttcttcgtaaatttatttctaagagtcaaatttccctgggttaaaattttacctctttttacatatccattttaactaaagtcttttggaattataggacatcagagcaatatatattgccttccttcattttatgctgcattattcaatgcatattaacagaactgtaatttctagtaaattttcactatattcaccctctttgtttttggtaataatcaacattttagaaaacattttactattatttaacctattacatataaacaaatgtgcacaggctgaaataataaagctccataaattgtatgaaagtgaaaagctccgttgcctccatcgctgaagcccctcgcatgcacctgccaaatcacttcccttatttttcctccagtgtaaccgcacatttgccttttataactgtttgttcggggcctgttttgggaacgttatctaattggacttgcacaacatgtattgtctgtgcatttgtgtgttatttgtatttatcactcattgtttatgaaattatccatgttgttatatgtagttgtagtttatttatttctgtttctagtactatttcataaatatactataccttatttattctactgttcaggaatttgcattgtgcctcaatgtctatttcaaataatgccatcataaatatattgtacatttctttgatgcccatgtacacagatttctctcaggtttttgcctaagagttgtgtttgtgggtcacagaatatgtgtgtatctttgtcttttgtagctaacaccaaccaattttccaagatgtttttacctgtttacattcctagtagtgcataaggctttctgctgggccacatcatctctacatttgtcaggttattttcatgttagccattttactgggtgacttttgtaatctcattttgaaattattttatatttaaatgaagttgagtacctttctattttattttggcaatttttataccttattttgtgcaatagctgctcaaatctcctatttctctagtctgttgtttttcttttcttttttctcttctttttgcttccatagaactttatttatttccttatcttgtttttcttattacttaaacaaatcttgtattctgaacataactcctttttttagtagttttcaacctcatggctagtttttaattcttttttgtcttttggtgaatagaaagtcataattttgattaaactcaatttatcaatttttgcttctgatcctatttcacaaagataattttctgtggtatcttttatttcattgtttacattacatctacaatccatttggaatatacatatttttatcattgttgtgaggtaggggtcaagatttatttttattccttcttattatttttattatactttaagttctaggatacatgtgcacaacgtgcaggtttgttacataggtatacatgtgtgccatgttcgtttgctgcacccatcaactcatcatttacattaggtatttctcctaatgctatccctcccccagtcccccacacctcaacaggccccagtgtgtgatgttccccaccctgtgtccaagtgctctcgttgttcaattcccacctatgagtgagaacatgcagtgtttggttttctgtgcttgtgatagtttgctcagaatgacggtttccagcttcatccatgtctctacaaaggacatgaactcacccttttttacggctgcatagtcttccatggtgtatatgtgtcacattttcttaatccggtctatcattgatggacatttgggttggttccaagtctttgctattgtgaatagtgtcgcaataaacatacatgtgcatgtgtctttatagtagcatgatttataatcctttagatatatacccagtaatgggtcaaatggtatttctagttccagatccttgaggaatcgccacactgtcttccacaatggttgaactagtttacactcccaccaacggtgtaaaagcgttactatttctccacatcctctccagcatgtgttgtttcctgactttttaatgattgccattctaactggtgtgagatggtatctcattgtggttttgatttgcatttctctgatgaccagtgatgatgggcattttttcatgtgtctgttggctgcataaatgtcttcttttgagaagtgtctgttcatatcctttgcccactttttgatagggttttttgtttttttcttgtaaatgtgtttaggttctttgtagattctggatattagccctttgtcagatgggtagattgcaaaaattttctcccattctgtaggttgcctgttcactctgattgtagtttcttttgaagatttattttttactaccatttttttgttggacttttaaaatgagtttggaagtgttccctctccttcaattttttttttttggaagagtttgaaaacaattatcattgattcttctttaaaagtttggtagaattctccaggaaagatatctggttttgggcttttgttgttgttgttgttaggaggtttggattactgattcaatctccttactagttacagctttgtttagattttttatgattatgtcttggtagtttgtatgtttctaggaattaatcaatttcttctaggttattgaattttttggtatatgattttaaaagcctcttataattgtggcatcaggtgtaatgccacctcttttgtttctgacttccagtctttttgtttttttcttagtctagctaaggggcttgtcagttttgttgttttttcaaaaaatcaactaagtttaaaaacttaatttaaactttttttcatttatttttgctctaatctttattatagtatttcctccctttgctttgggcttcctcatttgtcctttttttctagttccttgagttgttaagttttttatttgagatctttcttctttcttcatttttagtgtaggcatttacaactcccttctttgtttttgttttcatgtttaagagacaagatctcactatgatgtacagaggcacgatcatagctccctgcaagtgatccttgtgccttggattcccaaagcactgggattacaggcgtgagccactgagcttgcccagcttaatattccttcttagtactgcttttgttgtatcctgtaagtttttattgtgttgtgttttcatttttgtttatcttaacatattttctaattcatcttttgatttcccctttcattcaaatgaaattttgaacagaatttcgttcaaaattctgttgtttaatttctacatatttgcagattttccagttttaattccagtattgatttctagttttattccactgtggtcagaaaagatatttagtaggatttcaaccttcttgaatttgttaagacttgttttgtgacctgacgtgtgatttatcctggaaaatgctctgagtgtgcttgagaagactgtatatttgctgctgttgggtggaattttctgtatatgtctgttagttccatttcagctatagtgttgttcaagtcctctgcttccttgctgattttctgtctgaatgttctattccttattgaaagtaggataccaaaatctcctactacagtcattggagatacattctgagaattgtatcattctgagatttcatcactgtgcaaacatgagagtgtacttacatatttacacaaacctagatagtatagcctactacagacctaggttacatgatctattgcttctaggctacaaacctgtacatatgttaactgtactgaatactatagggaattgtaacacaatggtaagtatttgtatacctaaatatatctaaacatctaaaaggtacagtaaaaacattgtacagatttttaaaatggtacacctgaatagggtacttaccctatgaatggagactgcggggctggaaatttatctgcatgagtcaatgagtgaatggtgagtgaatgtgaaggcccaggacattactgtgcactaatgtagactttaaagcactatacatttaggctacactcaatttatcaaaaaattttctttttacaggctggtcatggtggctcatgcctgtaatcccagcactttgggaggctgaggaaggaggatcacttaagcccaggagttcaagaccagcctgggcaatatagtgagaccctgtctctagaaaataatttttaaaaattagctaggtgtggtgacacacacttgtagttccagctactcaggaggctgaagtgggaggatccttgacttgaggaggtcaaggctacagtgagctatggtcgtgccactgcactccagcctgagcaacagagtgagactctgtctcaattttttttctttcttcagtaataaattaaccttagcttactgtaacttttcaactttgtaaacttaaattttttaaccttttgactcttttgtaataacgcttagcttaaaacacaaacacattgtacagctgtacaaaaatattttctctttatatccttattttacaagtttttttgacttttaatttttttatttttttcacttttacttagtgtttttttttgttgttgttgttaaaaatgaagatataaacacccatactagcctaggactgtattgggtcaggatcatcaatatcattgtcttccacctccatatcttgtcccactggaaggtcttctggggcagttacacatgcgatgctatcatctcctatgataacaatatcttctagtggaatacttcccaaaagactttcctgaggctgttttgtggtgaccttttttcttttttttttttgagttaatgtattttttataagtagaaagagtacactgtaaaataccactaaaaagtatagtaaatacataaagcagtaacatttactatctgtatcaagtattatgtactgtaaattactgtacataattgtatgtgctatcttgtacttttatataactggtagtgcaataggtttgtttacaccaacatcaccacaaacatgtgagtaatgtgctacaacattatgactgctacatcatcactaggtgataggaatttttcagctccattataatcttatgggactactcttgtacatgtggtctgttattggttgaaacgttgttatacaacacttgactttattgtattgctatctatttctccatttctgtgaatgtttgcctcatatatttaggtgttttaatgttgggtgcatatgtatttataattgctatgtccttctggtgaattgaccttttatcattatataatgtccttctttgtctcttatgacactttttgacttaaagactattttgtgtgatgtagctgtttccacatttgcactcttttggttacaatttgcatgaaatttttttaatatcctttaactttcaggctatccaggtctttaaatctaaagcaaatctcttgtagttagcatataattgggtctttaaaaaaaatcaattcaaccactttgtatcttttgattgggggagtttatcccatttttatttaaagtaattattgatagggcataacttactgttgcctctttgttaattgttgtttgcagcttgtagactttttgctcctctttcctcctcttactgtcttcctttgtgttttattgagaattgtaatgctatgtttttgttcctttcctgttttcttttgtatatcttccataggtattttctttgtggttaccatggggcttacattttaaaactcttataaaaatgtattttaaactgatagcatctttactacaatcacaaaacaaaactcattatgtttacttctcccctacccaaattttatgttattgatgtcataaatacatctttttatattgtgtatacattattttatagttagtttttctgtacttttgtcttttaatcagattttaaaatatcagattttaaagtgacttttgtaccaccattacagtattatagtattctgtttttatctatatatttatctttactagtgagctttatactttaataaaatacctatgtatttctgtttagcatcccctaattttaactcaaaaggccccctcttaacatttcttgtaaggcaagtctaattgtgatcaccttcagcttttgtttaactgggaaggtctttatctctttttcatttttgaagacaaactttggtggatttggtattcttggctggcagttctttttcttttcagcactttcagtataacatctcacccctttctggatggcaaggtttctactgagaaatctactggtagagttaggggtgttcttttgtacgtgatgaggcatttttcttttgctgctttctaaattcttaacatttcttggatcttgatgtccatttccttcctcatatttgggaagttttcagatgtaattttaaaaaataagctgtctgtccttttctcttatggcttcttcttttgaaactgtcataatgagtagagcagcctgctcgaggatgtcctatcaatttcttaggctttctttactctctttcatttcttgctctttttgctactctgtctggataatttcaaatgatgtgtccttgagttcactgactcattcttctacttgattaagtctgctgttgaacatgtctgtaaaattttcagttcaattattgtattcttcagttccaaaatttctttttagttcttttgaatattttctatctgctgaaattctgattctgcttatgcattattttcctgagctcactgaacatctttatgacaattattttgaatactttgtcaagtaattcacatagctctatttctttaggtttggtttctggaggtgtgtttgtgtgtgtgtgtgtgtgtgtgtgtgggcacgcactatttgattgggccatgtttcctgttttctcatattccttattactttgtgttgatatctatacatttcaaaaaaacaaaaaacaacaacacaccagctacctcttccagtctttatggactggatttgtacatggaaagatctttactaatcaggctggctagagattctagggacctctcaaaccttttctgtggatgcatcttctatggacttgtgtgtataattcctaattagagggatctgccagcttttttttttaagatgctctaatctttttccctctgtggtgtctgtgtgctgtactgtgggccctctggagcagcagtattcactcagctcttttaggttctgagaagccctcagttatagattctgctgaatcctatcagtgcctggagtcaagtgagacagaaacttggactgcccactaaaattcaggaactttggatgcattttactctctctttccctcatgagagagagagtgctgagctgagtttctctctgtgtgctgtatcacaggtcctgaggagcatcagcccgccacccagctctttattattctgagctgccctcaggattttagaatatgccaggttccatcagtgctctgagatatgcaagacagctcccctgaaaagtcagaacactgaatgcatgctttactttctctttcccttctcagggagaagacaggagctgggaatttccccctgtttgaatggaactgtgctgctggatgggactatagggaaagtgccccagaaaagtgcccagctagttttacacttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattccaggcaacgctaagaccttgaatcattataccatttacttgtaccctactttttgttactgatatgcctttcaattatttatatgttctagacacacagtacattattatcattgttttgttaacacctatatatgtttctttctgggatcattttccttctgaagaaattaacatttcctttagtgtggcctgctggtaaagaaacctttacgtttttatatatctggaaatgtcttaattttactatcacttttgagaaacagttttgggtattgaatgaaagttatttttgccagcacttttaagatgacattccatggtcttcttttgagatgatggctgtcaagtttattgttcaattagtgtgtctttttttctgtctagctactttgtatacttactctgtttttcacttttaacagctttactatcatgtgcccagtgttaatttgctttgtttttaatctcgcttgcagttttcaaagcttcttatatctgtgggttgataatattttatcagtttaagagaagatttagcagtatgccttcaaatacggcttctacttcatattttctcttatattcttctgtgactataagtacatgtatgttaaatcttttcaccatattccttgtcttttatgtgccatttctgtttttaaatcactttttctctttgtttcataatccatgttttattctgacccatcttttactttaggaattttatcttgttattctaggccactgtcaaagtcattgattgaattcttaacttgaatcgtggcatttttccattttagaattttattttcctttttaaaaatatatttctaacttgggtactggctaatgtcaaaagaaactttcctcccacaaagttttcactcacttgatcttggattttaaaatcagatataacctgagagattatcatttttctccatttaataatgaatcaggccaggcatggtggctcatgcctataatcccaacacctgtgtgggccatgacaggaggattgcttgagcccaggagttcaagatgagcctgagcaatatagggagactccatctttacaaaaaatgaaaaaaattagctagatgtggtggtgcacacctgtggtcccagctacttgggaggctgaagttggaggatggcttgagcctgaggctgcaatgaactttgactgtaccactgcactccagcctcggtcagagtgagactctttgtcacccagttgtatagaatcaactataggtagaggcataaaaaagatgcctgagattgcatctcttgaatttagcttcattgtccctttctattaagtgagattatttgacatgaacattgatattcactatctcagggatatgttagaactattctcatattttctatccacagaggatatataatatggatattttagcacattcccttatagggcagttataccttcctctgtgactcattatacaggcagcgctaagatgtgtattatatgctcatggtatcctttcttactatccttataatagaataaattaatttttatacagaattaatttttgaagaatcaaatgacatatgtgcataaattatttatacatttttatacaattgcttcaacatttcctcttctctgcaatctggtatatctatataatttctatagataagagaagaaaaatatagcttattaaaattttattctgggttttgtaaggaataaaggacatttgtacccttatgaagattaaattttcttgtgttagtatatttctaaaggcttttagtgaattaaatggagacactttaatatactacacagttttaaatctaaatttttttctcaaggaagaacttctgtttacacaatgatgcttaaacatgactgaaatatctaaaggagaggttaactggatcagtcaagaaaataatctgtaacatttgattgaagaaaatagcttagaagaagattttttaaaatgttcttttcctgtggagtctcccatgaaattcagattggataatctatagttactgagaaaggaatattcaaaataagagttgatcactgtagcacaaatgcaagtgataatttaaaaagtaaatataatttaacagatatgaaagtgaatcaaaagtcaagagtcttgtttcctcctgaaatatctatataagtacatgagatattttttccagactgagaggagcatgtgaactgatattgttgatgactttttctccattgagtatatcttttaaaatactcagtatttatcataatactctgcagattacaatgtacacattgttaatactacattgttaatttgccttttaaatacttaatatttacttttttcaaaggttatctttgtgtattttgtataaaattctactataatttattccatagctttgtagttttacattatttactgttatataatagaaagtggctaacatcagctaatgctgttttctaaatatttattatcattttcttatgtttttaaccattgtgtattaaaatatttcaaaattatcagtatgaaaactattaggcaaatagtctgggaaattgatttgtgtttcaacgatccaaatattagtgaaaagtcatgataatagagatagtaaaaatcttataagggaactggtaaatatatctttaaagattgtatcagaaacaattctatgacaatatcttgtttctttacaagtttgaattccagaaatcaagtgaatttcctctgactttgcattttctggtaatttcttttttcttatcaagctatattttaaatgtaaaagtatccaacaatagaattgctaatctcttggtccctcttgtcttcacaggtaagggatattttgtaatatttaaggaattttatggagtatatatacaagcagaatgttagctatttcttcaatagaaaacttggtgatattttcttttgcccatatttattaagtgaagtttactaaattttctaggtcgtgttcaaatcataccatccagtaaacagttgggagattaaaaagtaattaaactaatataaagatagcctggttaataaaatgatattcttttcaacatgattatatttactggaacctaaacattttgtgaaatagtatgtcatatagacaatattaggattttgacttgttatgtaagtacaaaggtatgtattttacaatttttaataattgctttatcagtaatagcaacttgaagaaatgctatctagatgcttctaatttgaaaatagtgcaaagacgatttaccaaagtcgttctattatgcttttgatttctagaaagctgaaatatccccattacagtttttgagtcaatacaaaaagtagataggtgttatagataaagaaataggttttcatcgatttgaaaattagaactccgagaagaaactcaggtaagaatgccattaaaatagttttagttgtttttgaaaataacatcaacaaaatgtcactattaaacagtgaaattggaataaaaatttgttttatgagtaacacggagatagcatacaaacattccattgactaatacagaaaaaactcaaaagttttaattagatatgtttaaatagagatgagaaaagtcaaaactttaactcttaaaagttatttttatcagtttggaaatatataaactcctccctatataaaatacaccagcacaaatttctctagtaaggattggggtttcatgactttagatgtatttttctgtaatattttaatgacgcacttatattgacgcattttaagatagagtttaatgatatattttgactagagataagtgatttaaagaataagaatcatgtcattgaaagtgagaatacttgagaaatattgacgaatataagctaaataaagcaaaacaaaataaaacacttaccctttcatccacatgatgtcgctggacaccggaaggtttttctcccttcccagcctcaaaggaatacagtgagtagattttccttagacagaaaggaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattaaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttgtaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 2127 - DNA, 184281 bp, Homo sapiens; identical to SEQ ID NO: 2122

SEQ ID NO: 2128 - DNA, 217487 bp, Homo sapiens
gagaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaaggtgagtcttttactttttcttgccaattctaaaattgttctttttaaaaaattctatatgatttctactagttatttagattcatagttcttcatttattttatatcatcctaccgtgcgattttgaatatgaattagagatcaatttattgcatttactgaacaatttatttaaacaatctacataactgttttcttatttttacattttggcacttccatcattaagtcataagtaatagaccatgaaacactgaaaaacacctcagcaaaatttgtaaattaaacatttcccataaatattttctctcttaaaaattgaaaatcacaatcggaagaaattaaagaatttgattatataatacgtattttcaactgacactgtctatccaatctgtcggatagtgtttggaataacctatatcctggacatttcttagattgttctttggatcaacaatgcccttgtctatgcaatagttaataagctacattttttttttgtttgtttgtttttgttgagacagtcttgctctgtcacctaggctggagtgcagtggtgtgatctcagctcactataacctctgccacccgggttcaagtgattgtcttgcctcagcctccttagtaactgggattacaggcgcccaccaccacgcccggctattttcttttttaaattttttatttttagtagagacggggttggtctcaactaaatgttggccaggctggtctcaaactcctggcctcaagtgatccaccctcctaggcctcccaaagtgctgggattacaggagtgagccactgcacctggtctttttatttgtatttgaaagcagcctgagtggatattttaacaccagaatttccaaaagtatgtagcacaggttgttacaacaaaatgacagcacttaggaataactgctaatcttaagtatgttttttataagtaaaataacccattatttggtataaagatttcacactgataacatttttgagttatcaggcaaaaatagagagtattgagaaaagagaccctctcaattttgtttaatttgaaaatattaacatttaaaaatcacactggggtttttcaggtggtgggactttttcttcatttaagtggagactacccagtctttatgttaatggttgataaatcatcctttcagtatcattatcattaggccaatgtgtgcaggcctcccactgcagagattgactacttttttctggcatctaattctatgcgtgggaatacattttccattaatgtgagctcactcaattttacctggaagcatccatattcctaatgaaattggaatttttccaaaagatgaggcctggtcttggatgactacattttcacttgaaacatttattttgggtaattataacactgaactcgacaagtaaatgttacacttggaaagaacttttttagcttttccaaccaaaggcagatgtattgcaataaaataactgtcttaaacggtcctctactatttagttcttagttatttgctgtttattctaaatatatgtgcatattgataaatcatagaaataacttccactagtgatcttacctttagccatttcatagttaggtcagaatatccatttccaagtaatacttgaccactatgtttctaccataggtaaatgataagcttctaaaattatattcacatatatccaaatctccaggagtcacaatctgttgctctataagttttttcaaaacattcttatttacattttttcttggttgtctaagtgacatctaggtggtagtagaaattattcactgatactttatctacaaaatggctcaatcttctaaactcatagttcctttaatattacctttatctcttaataatcagtatggagtctactctgctataaattctcatgtgacattccattttgcaattagtataactcttaaaggtactgaaaagtgcagtattacaataagttgtcaaaggcatctcattactatgaagtccatgaagtttaaaaattttaaatttatctcttattttcaaactagctaccatctttaaaaattcagcaaagtggtaactggaatattaatagctataattatttcttaggtccatgcttttcagaaataatgcttaaatgtttacttacttcttcataatatagcacaatataatcatttagaaattatgtaagtttgatattaacaaatatcattaacttacatttttatttatcttgcttgaaaaagttaattcaaaatattaatttatttattcatgaaaacaacaattgataatttatcctattctaaatatgaatgataaaatctgagtaagttgcagtcctggcttccatttcatgaatacacaggaaacaaaagctgaaatgaaaacttttcccctaaatatttaaatcacatgtttgatttcatttttaaatggtctgggtataagcaaaaatttgtacattattttatttctctaaatttgacctctttccataaattttctttgccccacttccaaatgcggcgagaattcatgcttctcattgaattcacagatatctttagaatgttttattgcttagtgttaaatatgttgagtaaatactggcttatgttcctaggttacttttctcccttcactgtttagttaaataatcaattctttcaagtaacaacttttaaaaaaactggaatctagaaattcatcaggagtggagatcatcaaaaacgtaattactttatattgttaacattttagtatatacaggtaaattcaaatacataaagagtgtggaaaaattaaacctaatatattcttaattgatgtgatgtgagtgtaacaaatatacaaatcacattcccacaataggaaacaaatttcctgtttgaatttctctgtaaaggaccgacttctgaaatctttatgtaagttacagtcaagacagttgatgaggctatagttcttgaaaaaggggcatgggagggaattacagacattctacaaatttaaaaaaccataaatgtacatattttaagaaattaacagttgctgtaataacataaaagtagatatatgtatgttttaatatatacagcacacacacacttttaaatacttcaacatctcaatgttttgatgatcataaatctgaaaggatctgatttttctataaaatgtaacttgggtggtaaagaggttaatggtaagttgtcttgaatcagattgaaatcccatcgtaccaagagataatatcgttttacttaacctctatgtgtttataaaaagcgaataatattaaaacttatttcagaggattgtgataatttaacgggataattccattaagacaaatagaaaagtggctgtcacatgggaaatatttccaatagatgtccactgttaaaacaggaatcacaatattttagtgtatgtcatgaattagcacaattgatagtgaattagtataaaagttctaaggaaatatttagataaaatataaggactttgaggagtgaccgaaggatattacaattgaaactagaaattttgggaaagttcaaacgacatacaaggaaaagaagatacgtttacatatttaatacttacacgtttagccacatgatgtcgctgtccaccacaaggtctttctccacaaaagaaataacagcgtgcattacgtattcagatactgctttgcttcatcctctctaaaatttaacaccgaggagtttaagaaatgaagataaggaactcgaattatttttaaactttggatcaatgtaaaggcaatctaatatttggaaaatacttgcaatgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaatagttaagtatgaattatgtgattcataattagacttttccagttttgtggttttgtggttaaaacggtaagatttttgttgctaatttttgaaccaaatcagcagtaagttatgatatccacacttgtaattttgttttgttattaggtgcagtagtagaattattttattgctaaatgcctgggtataagacaaatattttttcttagatgaattgcattatttagagaatctgacttcgacttgttttatacttatccctatacaatgcttcttcaatatcttttgccacttttcatttggacttcctactacctgttagtacaaatgttacttgctcattttatgagttcacctaatgcttataactccctattgattatgcttttccaccttcagtttcaaaaattagatcattacacctgttgtcttttatggaacctcttttattctcttattcacttgtttggagtctcaatccttattttttacttgaatatgattcattttaggccttgtgctctaatttggcaataccgtttattgtttcttgatttcccagttgggaaaaaaatcgagaataacaattgcatttagaattgcatctttgttcatctttagtttatcactactttatttaatactactttaataatactactgtattatatgttaaaatttattactaataactaaaatatcaatatgaagtgaaaatttaatagttgtatagtatatttatatattcattttaaaagaatgttttaaatcttgttaaaaataattttcaatctgaacaatatcttgaaaataattatggtatctaattttaaaactatccctactagcaaaactttttattcattagtgtcttttgcataccatactaaggatgctaatatgaaataagtttgataagccaatgttataatgttattactggttaacttctctgaatagcatcctgcctattaatgtgtgccatgcaataagtagaaaactccaaataaccagaaccaaatgaaattgaaggtagacttttttctaatcactacccctacatatttggttatctcctctagcaattagttggactcccatttaagtttccctaccactggagagaaatagtaaccaactgaaacctggttaatactcattgacagtgtgggaggtctaacacgtaaaatagatatttttcttgactcctctccttcccctcacttccattttctttatttccttttttggcactatcctttgttgctcccttgtccatgaagtagtagccatagtgtgtccatctcaggtcagtattttaaaaatttagttctgttatcagcttcttgaatataatagagtcagccaaagtacttgtcttcccagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaagaaaatgtattgtggtttatttattgggaagtcttcattccccattaatacccaggatgattcaaagatcatgattaccaagaattagaataaaaattaagctaaaacccaagttttcaacattgaacttgaaatacatcttaattggggaaatgtctagagactttttttgtatctttagaaaatcatagaggctattgaaacaccacattttcccaactagatatgcgatcaccttaaattaatgcattttattaggcaatggaaggaagcaaacattttctgcagggtaaatatttaggaaatattaggtaagtccctctgagctattaaacaattaagatacaactattccctttaaaatatatattccaaaaaaggacacacatactcaaatgcttataagagataaattaatgtaataaatggcccacgcgattccaccctggtgctgcagtttgtaaaagaagaaaaaatacctgttcaattggtttgatcatgacattcttcatgggtcagggaagttttaagtggttataaaatggggtaaattggctttagaagagtttagaaatgatgtggattacttatagacaggacaaaatgaacatgcttgtttattaaaaaaagctattggaagcaggaaatattcagtttggctaaaatatataagcactataggagaaaatagaagcttaggcacattacatactggagaacaagcaagtacttataaactgtaagagtcaaaatgagaataccagcgtttctcatgggagcaaatgagttccaatgaataaaattatttggaatgcttttccatgcaagctatttgctataacttcctgcttccttgcactttcagccctgacatgactcaaggaagacatctaattaaatgctgatggtctttgatccttttataaaacatctgcaaatttccctgtcaatagcttgttcttggcaccagaagttccctagagaccagtcccctcaagtcaacaacaccagaaatactagggtgaagagggtgttatcattaataaaaaaaaaccctggaattcttgggaacacaggaatctgtaatgaatttttctaatcaacagtttacagttacatgtttacaaagtgtatagttaggtctctgtaatacttaaaacctgtgttgaaaaaattatttctactgaagtaaaagttgcccctatggcgaaactaaggaccacactcaatcaatcagtggtacaatgtgtaccacagtagtacaaaatgtattcctattctccgaaacgactgaaataataaataaaaccaagtagtttacagtagagtgtgtgggggtttccacaattgctacttacggtttggagccacatgatgtcgctctttaccacaaaatacatgagagaaggaggaagaagggaaaattccttctattcttactggaaggaaccatatacactctttggagtctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataacatccttttgtttaattttcgtattgtttttctctatcaacttcttcgtaaatttatttctaagagtcaaatttccctgggttaaaattttacctctttttacatatccattttaactaaagtcttttggaattataggacatcagagcaatatatattgccttccttcattttatgctgcattattcaatgcatattaacagaactgtaatttctagtaaattttcactatattcaccctctttgtttttggtaataatcaacattttagaaaacattttactattatttaacctattacatataaacaaatgtgcacaggctgaaataataaagctccataaattgtatgaaagtgaaaagctccgttgcctccatcgctgaagcccctcgcatgcacctgccaaatcacttcccttatttttcctccagtgtaaccgcacatttgccttttataactgtttgttcggggcctgttttgggaacgttatctaattggacttgcacaacatgtattgtctgtgcatttgtgtgttatttgtatttatcactcattgtttatgaaattatccatgttgttatatgtagttgtagtttatttatttctgtttctagtactatttcataaatatactataccttatttattctactgttcaggaatttgcattgtgcctcaatgtctatttcaaataatgccatcataaatatattgtacatttctttgatgcccatgtacacagatttctctcaggtttttgcctaagagttgtgtttgtgggtcacagaatatgtgtgtatctttgtcttttgtagctaacaccaaccaattttccaagatgtttttacctgtttacattcctagtagtgcataaggctttctgctgggccacatcatctctacatttgtcaggttattttcatgttagccattttactgggtgacttttgtaatctcattttgaaattattttatatttaaatgaagttgagtacctttctattttattttggcaatttttataccttattttgtgcaatagctgctcaaatctcctatttctctagtctgttgtttttcttttcttttttctcttctttttgcttccatagaactttatttatttccttatcttgtttttcttattacttaaacaaatcttgtattctgaacataactcctttttttagtagttttcaacctcatggctagtttttaattcttttttgtcttttggtgaatagaaagtcataattttgattaaactcaatttatcaatttttgcttctgatcctatttcacaaagataattttctgtggtatcttttatttcattgtttacattacatctacaatccatttggaatatacatatttttatcattgttgtgaggtaggggtcaagatttatttttattccttcttattatttttattatactttaagttctaggatacatgtgcacaacgtgcaggtttgttacataggtatacatgtgtgccatgttcgtttgctgcacccatcaactcatcatttacattaggtatttctcctaatgctatccctcccccagtcccccacacctcaacaggccccagtgtgtgatgttccccaccctgtgtccaagtgctctcgttgttcaattcccacctatgagtgagaacatgcagtgtttggttttctgtgcttgtgatagtttgctcagaatgacggtttccagcttcatccatgtctctacaaaggacatgaactcacccttttttacggctgcatagtcttccatggtgtatatgtgtcacattttcttaatccggtctatcattgatggacatttgggttggttccaagtctttgctattgtgaatagtgtcgcaataaacatacatgtgcatgtgtctttatagtagcatgatttataatcctttagatatatacccagtaatgggtcaaatggtatttctagttccagatccttgaggaatcgccacactgtcttccacaatggttgaactagtttacactcccaccaacggtgtaaaagcgttactatttctccacatcctctccagcatgtgttgtttcctgactttttaatgattgccattctaactggtgtgagatggtatctcattgtggttttgatttgcatttctctgatgaccagtgatgatgggcattttttcatgtgtctgttggctgcataaatgtcttcttttgagaagtgtctgttcatatcctttgcccactttttgatagggttttttgtttttttcttgtaaatgtgtttaggttctttgtagattctggatattagccctttgtcagatgggtagattgcaaaaattttctcccattctgtaggttgcctgttcactctgattgtagtttcttttgaagatttattttttactaccatttttttgttggacttttaaaatgagtttggaagtgttccctctccttcaattttttttttttggaagagtttgaaaacaattatcattgattcttctttaaaagtttggtagaattctccaggaaagatatctggttttgggcttttgttgttgttgttgttaggaggtttggattactgattcaatctccttactagttacagctttgtttagattttttatgattatgtcttggtagtttgtatgtttctaggaattaatcaatttcttctaggttattgaattttttggtatatgattttaaaagcctcttataattgtggcatcaggtgtaatgccacctcttttgtttctgacttccagtctttttgtttttttcttagtctagctaaggggcttgtcagttttgttgttttttcaaaaaatcaactaagtttaaaaacttaatttaaactttttttcatttatttttgctctaatctttattatagtatttcctccctttgctttgggcttcctcatttgtcctttttttctagttccttgagttgttaagttttttatttgagatctttcttctttcttcatttttagtgtaggcatttacaactcccttctttgtttttgttttcatgtttaagagacaagatctcactatgatgtacagaggcacgatcatagctccctgcaagtgatccttgtgccttggattcccaaagcactgggattacaggcgtgagccactgagcttgcccagcttaatattccttcttagtactgcttttgttgtatcctgtaagtttttattgtgttgtgttttcatttttgtttatcttaacatattttctaattcatcttttgatttcccctttcattcaaatgaaattttgaacagaatttcgttcaaaattctgttgtttaatttctacatatttgcagattttccagttttaattccagtattgatttctagttttattccactgtggtcagaaaagatatttagtaggatttcaaccttcttgaatttgttaagacttgttttgtgacctgacgtgtgatttatcctggaaaatgctctgagtgtgcttgagaagactgtatatttgctgctgttgggtggaattttctgtatatgtctgttagttccatttcagctatagtgttgttcaagtcctctgcttccttgctgattttctgtctgaatgttctattccttattgaaagtaggataccaaaatctcctactacagtcattggagatacattctgagaattgtatcattctgagatttcatcactgtgcaaacatgagagtgtacttacatatttacacaaacctagatagtatagcctactacagacctaggttacatgatctattgcttctaggctacaaacctgtacatatgttaactgtactgaatactatagggaattgtaacacaatggtaagtatttgtatacctaaatatatctaaacatctaaaaggtacagtaaaaacattgtacagatttttaaaatggtacacctgaatagggtacttaccctatgaatggagactgcggggctggaaatttatctgcatgagtcaatgagtgaatggtgagtgaatgtgaaggcccaggacattactgtgcactaatgtagactttaaagcactatacatttaggctacactcaatttatcaaaaaattttctttttacaggctggtcatggtggctcatgcctgtaatcccagcactttgggaggctgaggaaggaggatcacttaagcccaggagttcaagaccagcctgggcaatatagtgagaccctgtctctagaaaataatttttaaaaattagctaggtgtggtgacacacacttgtagttccagctactcaggaggctgaagtgggaggatccttgacttgaggaggtcaaggctacagtgagctatggtcgtgccactgcactccagcctgagcaacagagtgagactctgtctcaattttttttctttcttcagtaataaattaaccttagcttactgtaacttttcaactttgtaaacttaaattttttaaccttttgactcttttgtaataacgcttagcttaaaacacaaacacattgtacagctgtacaaaaatattttctctttatatccttattttacaagtttttttgacttttaatttttttatttttttcacttttacttagtgtttttttttgttgttgttgttaaaaatgaagatataaacacccatactagcctaggactgtattgggtcaggatcatcaatatcattgtcttccacctccatatcttgtcccactggaaggtcttctggggcagttacacatgcgatgctatcatctcctatgataacaatatcttctagtggaatacttcccaaaagactttcctgaggctgttttgtggtgaccttttttcttttttttttttgagttaatgtattttttataagtagaaagagtacactgtaaaataccactaaaaagtatagtaaatacataaagcagtaacatttactatctgtatcaagtattatgtactgtaaattactgtacataattgtatgtgctatcttgtacttttatataactggtagtgcaataggtttgtttacaccaacatcaccacaaacatgtgagtaatgtgctacaacattatgactgctacatcatcactaggtgataggaatttttcagctccattataatcttatgggactactcttgtacatgtggtctgttattggttgaaacgttgttatacaacacttgactttattgtattgctatctatttctccatttctgtgaatgtttgcctcatatatttaggtgttttaatgttgggtgcatatgtatttataattgctatgtccttctggtgaattgaccttttatcattatataatgtccttctttgtctcttatgacactttttgacttaaagactattttgtgtgatgtagctgtttccacatttgcactcttttggttacaatttgcatgaaatttttttaatatcctttaactttcaggctatccaggtctttaaatctaaagcaaatctcttgtagttagcatataattgggtctttaaaaaaaatcaattcaaccactttgtatcttttgattgggggagtttatcccatttttatttaaagtaattattgatagggcataacttactgttgcctctttgttaattgttgtttgcagcttgtagactttttgctcctctttcctcctcttactgtcttcctttgtgttttattgagaattgtaatgctatgtttttgttcctttcctgttttcttttgtatatcttccataggtattttctttgtggttaccatggggcttacattttaaaactcttataaaaatgtattttaaactgatagcatctttactacaatcacaaaacaaaactcattatgtttacttctcccctacccaaattttatgttattgatgtcataaatacatctttttatattgtgtatacattattttatagttagtttttctgtacttttgtcttttaatcagattttaaaatatcagattttaaagtgacttttgtaccaccattacagtattatagtattctgtttttatctatatatttatctttactagtgagctttatactttaataaaatacctatgtatttctgtttagcatcccctaattttaactcaaaaggccccctcttaacatttcttgtaaggcaagtctaattgtgatcaccttcagcttttgtttaactgggaaggtctttatctctttttcatttttgaagacaaactttggtggatttggtattcttggctggcagttctttttcttttcagcactttcagtataacatctcacccctttctggatggcaaggtttctactgagaaatctactggtagagttaggggtgttcttttgtacgtgatgaggcatttttcttttgctgctttctaaattcttaacatttcttggatcttgatgtccatttccttcctcatatttgggaagttttcagatgtaattttaaaaaataagctgtctgtccttttctcttatggcttcttcttttgaaactgtcataatgagtagagcagcctgctcgaggatgtcctatcaatttcttaggctttctttactctctttcatttcttgctctttttgctactctgtctggataatttcaaatgatgtgtccttgagttcactgactcattcttctacttgattaagtctgctgttgaacatgtctgtaaaattttcagttcaattattgtattcttcagttccaaaatttctttttagttcttttgaatattttctatctgctgaaattctgattctgcttatgcattattttcctgagctcactgaacatctttatgacaattattttgaatactttgtcaagtaattcacatagctctatttctttaggtttggtttctggaggtgtgtttgtgtgtgtgtgtgtgtgtgtgtgtgggcacgcactatttgattgggccatgtttcctgttttctcatattccttattactttgtgttgatatctatacatttcaaaaaaacaaaaaacaacaacacaccagctacctcttccagtctttatggactggatttgtacatggaaagatctttactaatcaggctggctagagattctagggacctctcaaaccttttctgtggatgcatcttctatggacttgtgtgtataattcctaattagagggatctgccagcttttttttttaagatgctctaatctttttccctctgtggtgtctgtgtgctgtactgtgggccctctggagcagcagtattcactcagctcttttaggttctgagaagccctcagttatagattctgctgaatcctatcagtgcctggagtcaagtgagacagaaacttggactgcccactaaaattcaggaactttggatgcattttactctctctttccctcatgagagagagagtgctgagctgagtttctctctgtgtgctgtatcacaggtcctgaggagcatcagcccgccacccagctctttattattctgagctgccctcaggattttagaatatgccaggttccatcagtgctctgagatatgcaagacagctcccctgaaaagtcagaacactgaatgcatgctttactttctctttcccttctcagggagaagacaggagctgggaatttccccctgtttgaatggaactgtgctgctggatgggactatagggaaagtgccccagaaaagtgcccagctagttttacacttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattccaggcaacgctaagaccttgaatcattataccatttacttgtaccctactttttgttactgatatgcctttcaattatttatatgttctagacacacagtacattattatcattgttttgttaacacctatatatgtttctttctgggatcattttccttctgaagaaattaacatttcctttagtgtggcctgctggtaaagaaacctttacgtttttatatatctggaaatgtcttaattttactatcacttttgagaaacagttttgggtattgaatgaaagttatttttgccagcacttttaagatgacattccatggtcttcttttgagatgatggctgtcaagtttattgttcaattagtgtgtctttttttctgtctagctactttgtatacttactctgtttttcacttttaacagctttactatcatgtgcccagtgttaatttgctttgtttttaatctcgcttgcagttttcaaagcttcttatatctgtgggttgataatattttatcagtttaagagaagatttagcagtatgccttcaaatacggcttctacttcatattttctcttatattcttctgtgactataagtacatgtatgttaaatcttttcaccatattccttgtcttttatgtgccatttctgtttttaaatcactttttctctttgtttcataatccatgttttattctgacccatcttttactttaggaattttatcttgttattctaggccactgtcaaagtcattgattgaattcttaacttgaatcgtggcatttttccattttagaattttattttcctttttaaaaatatatttctaacttgggtactggctaatgtcaaaagaaactttcctcccacaaagttttcactcacttgatcttggattttaaaatcagatataacctgagagattatcatttttctccatttaataatgaatcaggccaggcatggtggctcatgcctataatcccaacacctgtgtgggccatgacaggaggattgcttgagcccaggagttcaagatgagcctgagcaatatagggagactccatctttacaaaaaatgaaaaaaattagctagatgtggtggtgcacacctgtggtcccagctacttgggaggctgaagttggaggatggcttgagcctgaggctgcaatgaactttgactgtaccactgcactccagcctcggtcagagtgagactctttgtcacccagttgtatagaatcaactataggtagaggcataaaaaagatgcctgagattgcatctcttgaatttagcttcattgtccctttctattaagtgagattatttgacatgaacattgatattcactatctcagggatatgttagaactattctcatattttctatccacagaggatatataatatggatattttagcacattcccttatagggcagttataccttcctctgtgactcattatacaggcagcgctaagatgtgtattatatgctcatggtatcctttcttactatccttataatagaataaattaatttttatacagaattaatttttgaagaatcaaatgacatatgtgcataaattatttatacatttttatacaattgcttcaacatttcctcttctctgcaatctggtatatctatataatttctatagataagagaagaaaaatatagcttattaaaattttattctgggttttgtaaggaataaaggacatttgtacccttatgaagattaaattttcttgtgttagtatatttctaaaggcttttagtgaattaaatggagacactttaatatactacacagttttaaatctaaatttttttctcaaggaagaacttctgtttacacaatgatgcttaaacatgactgaaatatctaaaggagaggttaactggatcagtcaagaaaataatctgtaacatttgattgaagaaaatagcttagaagaagattttttaaaatgttcttttcctgtggagtctcccatgaaattcagattggataatctatagttactgagaaaggaatattcaaaataagagttgatcactgtagcacaaatgcaagtgataatttaaaaagtaaatataatttaacagatatgaaagtgaatcaaaagtcaagagtcttgtttcctcctgaaatatctatataagtacatgagatattttttccagactgagaggagcatgtgaactgatattgttgatgactttttctccattgagtatatcttttaaaatactcagtatttatcataatactctgcagattacaatgtacacattgttaatactacattgttaatttgccttttaaatacttaatatttacttttttcaaaggttatctttgtgtattttgtataaaattctactataatttattccatagctttgtagttttacattatttactgttatataatagaaagtggctaacatcagctaatgctgttttctaaatatttattatcattttcttatgtttttaaccattgtgtattaaaatatttcaaaattatcagtatgaaaactattaggcaaatagtctgggaaattgatttgtgtttcaacgatccaaatattagtgaaaagtcatgataatagagatagtaaaaatcttataagggaactggtaaatatatctttaaagattgtatcagaaacaattctatgacaatatcttgtttctttacaagtttgaattccagaaatcaagtgaatttcctctgactttgcattttctggtaatttcttttttcttatcaagctatattttaaatgtaaaagtatccaacaatagaattgctaatctcttggtccctcttgtcttcacaggtaagggatattttgtaatatttaaggaattttatggagtatatatacaagcagaatgttagctatttcttcaatagaaaacttggtgatattttcttttgcccatatttattaagtgaagtttactaaattttctaggtcgtgttcaaatcataccatccagtaaacagttgggagattaaaaagtaattaaactaatataaagatagcctggttaataaaatgatattcttttcaacatgattatatttactggaacctaaacattttgtgaaatagtatgtcatatagacaatattaggattttgacttgttatgtaagtacaaaggtatgtattttacaatttttaataattgctttatcagtaatagcaacttgaagaaatgctatctagatgcttctaatttgaaaatagtgcaaagacgatttaccaaagtcgttctattatgcttttgatttctagaaagctgaaatatccccattacagtttttgagtcaatacaaaaagtagataggtgttatagataaagaaataggttttcatcgatttgaaaattagaactccgagaagaaactcaggtaagaatgccattaaaatagttttagttgtttttgaaaataacatcaacaaaatgtcactattaaacagtgaaattggaataaaaatttgttttatgagtaacacggagatagcatacaaacattccattgactaatacagaaaaaactcaaaagttttaattagatatgtttaaatagagatgagaaaagtcaaaactttaactcttaaaagttatttttatcagtttggaaatatataaactcctccctatataaaatacaccagcacaaatttctctagtaaggattggggtttcatgactttagatgtatttttctgtaatattttaatgacgcacttatattgacgcattttaagatagagtttaatgatatattttgactagagataagtgatttaaagaataagaatcatgtcattgaaagtgagaatacttgagaaatattgacgaatataagctaaataaagcaaaacaaaataaaacacttaccctttcatccacatgatgtcgctggacaccggaaggtttttctcccttcccagcctcaaaggaatacagtgagtagattttccttagacagaaaggaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattaaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttgtaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 2129 - DNA, 156297 bp, Homo sapiens
gatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 2130 - DNA, 226055 bp, Homo sapiens
aatggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatgtaagtccaactttcgagttttggctttaaatatttttcatatttaacttgtctaatcatcttttcaaatatcactttaaaaaatgtcttcaaggtgttcactaacgttgaaataaatcataccattgaatgtagatatcctattaatggcagttttgtcttgaatggaactagaaagcaaagaaaaatgtagggacaaattgtcgtatttcttgatttaaatggcaggttaaaaaagctacaatacaaggtacaataaaaggtaatgttggtcatatttaacacaatatctcaatgtagtaaaataacagtgacatattcggggtaacttattatgttatcttttctggtgaaatgtcaagccccggacaaacaattcttgacaaagttacagaaatcatctgccttccctttacgtggctaagtttcaaagtgaacaataaactgaagttttaagcaaacgtaatttaaaatacatttattggctgggggcggtggcttatgcctgtaatcccaaaactttgggaggccgaggagggcgtatcacctgagatcaggagtttgagactagcctggacaacatggtgaaaccccgtctcaactaaaaatacaaaaacattggccaggcctggtggtgggcgcctgtaatcccagctaatggggaggctgaggcaggagaatcgcttgaacccgggaggcagaggttgtagtgaaccgaagtcgcaccattgcactctaacctgggcgacagagtgagactctgtcaaaacaaaaacaaaaacaaaccaaaaccgaccaaccaaacaaacaaaaaacaccatttattgggcgatttgtttaatttctttatgaaaacatacaaccacgacttcattgtcattgtgaacaatttcctgatgccattaaccttgaattcccctgggtctagaaggcttagcattgcatgtatttgctatttcggggatccagttaggaaacacttattaagcacctcccattcctcccattcactcacaaatgttctaaaaccctttacttttttagctcattcgatccttccaacgattttatgaagtgaagactttcgtcacattttgtggataaaggtgctgaggctcgcaaaacctaagttcagtattattactaagttttcttcaaatttcccgaggatatccaaaaacttgcttgctgttaatacagttctttacctttcctaaaatgtttaaggtggcttacagtggaagaaatttgtgaaagcaaattattaaaaaatctgcttaaggtcaaagtaaaagatcaagagaaaggtgggagtcattatttcaaaaatcaagcctaggctgagtgaaaatcccaatacttaccttcctgtaagtcaatatagaagtatgaaaaaataacaataaaaggaaattctctataccatttcttcaagagagaaaaaatagcctcttcctgctacaaaatcaaggaagatttgattactgatgattgtgtaaaggttgagaaatatactgggcagcacgttttatagcagttttgcaaaacccacggaaatatccttgatgtagacatcattgtatttggtagtcattcagtcaagggcataatgttaaattttatttcctatgtttgcttctgaagttacttaaatattaaatgaatatatttttgtttgtcaaactttcaaacatacatgaatgtccccttgtgaagacattctatgagaaattaatataatttgctagttaagtttccagagatttgagttgatacagagttgttgcttagagtattgtaaaaaataggctgtaaacatgttctgtaacttttaatatattatcgtactcagccttttggcaagaatcagaaaaaaataatcttagcatcacgttgccaagaaaatgtcccagttcctcaaaatatgagacaaactttgcaggattataaaattggaaaaaatagatcagaaaatcacaaaataatttctctttccaattcacattactgtgtccccaaagcttcatttgctaacagtattaatggccaggcttaggattgcctttacatacattcaatatttctttatttagttttctaggttagttgagtgtattaacctgaaggtgaatcacaaataatagtgaattactattaaaccaaaaataaatgggcgtaggagtacaaaatttgaaaagtaatttttatgaaaaggtaattctagaatggaggaaaaaatgattgtggagtggtattgtcacttagtgtttattttaatgtaaatatgaatggatttcccattggtagttaaagttcttgctccattccaaatcttcatatagttaacacaactttcaacaggtttatctttcttcacaagatttcatccacaaactagtaaggtatcatttgagggaccttagagacttgtggtcagtgaaggatgcaaatagatgaaaatgagaaatagtttatattgctagccactaccgatattcctctgagaatgctggaggatttcacttttctgttattttgaggtagcacgattgtgtaatttcctttggccaatgaaatgtgaatggtgtgtcacttccaagcagaattatgtaactgccagtgaaagactcttctgctatcttttcctgttacagcaattacataagcactggttgatactgagacaccataaagtcaaagcaatccaggatgctgagccaacatgtggagaaaagctgtcataggaagtccccaataactacaaaggactctgcagcagcaagaaataaaattatgtttattttagaggaaaaactgaatgttaactcacaacagcatatgtattgaggtcccactgccattaagctaatatgaaccagataaattttaagaggggggcattttttttacaacaggaaatacaactgtaggagaacattattgttgacactttttactaagacatctgaccgttaagcagattagataacttgaattccatggaaaaaatctactgtgttttgatttctttttcttaaatataaaaggtagcagaagaaaaataataaactgaaatttaaaatgtcatagatattccttcttttttcttgcttagcatccactccccttgttgtttttttcttctggggtcttctagtagttttgtgaaagactaggttgaaggttttgcaagaatgagtgcttggacatgtaaacgttaagggatatacagttccatagataggtgcaaagggtataattttagcaatgggtactatattaatttccttgggctgatgcaacaaattaccacagacttggtggcttgaaataacagaaatttattttcttacagagtctctgtaagaataaatttcttctctcttatggaggccagaagtccaaaatcagcgtgtttcctgggccgcatttcttctgaagactttaggggaaatttttttcttggatcttccagcttctggtagctcttggcattgcttggcttgtggcagcataactccagttcctgcctctgtcttcacatttccttctttcctgtgttactatatgccttctctttttctgtcttttataaggggcaaccatcattggatttatggccttctgtaatctaggatgatctcatatcaagatcctcatctttgttacatctgcaaagacctttattccaaataaggtcacttatttaaacctcagaaaagtgatgtcttttggggtatctttgacccaaaacaggtaccaagagatatcaagtgcagtgggaggaaggatatttgctgagcatggcttcttaatctcttttccccgttgtgggggaaatgtacttgcatatctggcaatagtattctatctccgggggaagggggaaatattccatattctcagaaatcctaaataacagcacaaaatgcctcttatacccccacatatgtcattctgaatatccggtataattaattaccttatatgattgcagaaattgtctcaagcaagccatgtttcctgaagctagcatctggattctaggtataattccttctatgtgtcaacagtggtcaatgttggctatagattaaataataattactgggtatcatacatatgcaattgctttgcaactacataatgctgtaacgagcagttctgaagctatctgccatctgtttaagctccaggagaatttgggtacatgccatgacctccacttttcagttcacataaaaaccaacctcccacttttcagttcacataatttaggtggagctgatttcatttcctggcttcaagaatgagcaagtggacccatgtctagccaatgtgagaaaaatcacaattattgactaaaggaaatttacatcatccaaactgggctgtaggaagtaatatccaggatttttgctggactattagaaaagagcactttctggtaagagtcatcaaactggtaatttttagtctagaaagctactttggccattttgccagcagatgggaaaagtctatctgagaagaagttcagcaggggaaaaggaattataaatgtggagattattttccttatggaattatggaagggtgtagacccagctctgtctgaaaccagtaattaattacccatttccatgtatgagtcagtacaggattctctggtttatttttgcttaaatcggttaacttgggatttactgttagagtatgattaacataaatacacatttccatagatggtacaaatgagtatcttaagatactgtacatgagggaaaaaaattgttattggaaaaaaagctagcttttcttaacaagagctttgcttttctcttacggacattgcaaattttgcaattaattttacttctctctttgctctaggaagctgaaaacaaaattggtgacatggttagagtaactgaaggtgaccctttattatggattttgtatgctatcccactccttgattcattttatttcatcctcatcttatctttattctattttcatttttttactgtgaagggatcagctaaaaattaacaaaagaagatattctcaagtaattaacacaaaaaaagagatcgattgtattgttcttgcataaaagtctaaatgtaatggaaaaggaatattctaaagtaatagtacattatccaaatgagaaacaaataaattattaatttcaaaacatttgcaaacaattcaaaaatcaaaattaaatcacaaaacaacagtatatatacacatatattttcaatggactaaaatacctttgattactatgttcttcatttgaagaaatagtgaaaaatgctaatatatccaaaagaattgaaagcagggtctcaaagaaatatatgcacacccatgttcatggcagcactgttcacaacagtcaagaaatggaagcaactcaaatgtccacgaatacttgaatgaataaacaaaacgtggtgtatacatatgttggactattattcagccttaaaaaggaaagaagtcctgtcacatgttacaatatggatgaaccttgaggaaccatccacggatgcttgaatgaataaacaaaacgtggtgtatacatacgatggactagtattcagccttaaaaaggaaataaatcttgtcacatgctacaacatggatgaaccttgaggacattgtgctaagtgaaataggccagtcacaaaaagacaaatactttacgagtccacttacacgaaatatctaaagtagtgaaattcatagaaatagaaaataggactgtggttaccagagactggagtgacggtgaaaagcggagttgttgtctaatgggtatagagtttctgttttccaagatgaaaaatttgtaacaatgtgaatatacttaacattactgaaatgtacatttaatcatagttaatatggtaattttaaatattatgttgtgtgttttttaaccagagtaaaaaagggtaaaaaggtaatatattttagggcttaaaatagttatttttttccaagatgaaagctatgagtaaacttaaaccagaaaatcgactagttttaaatctacagaataaacagtagagccttccttttagccacatgatgtcgctgtccaccatagagtgttctctaggaaggaaaatacccagagcccctttgttacttcagagaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaaggtgagtcttttactttttcttgccaattctaaaattgttctttttaaaaaattctatatgatttctactagttatttagattcatagttcttcatttattttatatcatcctaccgtgcgattttgaatatgaattagagatcaatttattgcatttactgaacaatttatttaaacaatctacataactgttttcttatttttacattttggcacttccatcattaagtcataagtaatagaccatgaaacactgaaaaacacctcagcaaaatttgtaaattaaacatttcccataaatattttctctcttaaaaattgaaaatcacaatcggaagaaattaaagaatttgattatataatacgtattttcaactgacactgtctatccaatctgtcggatagtgtttggaataacctatatcctggacatttcttagattgttctttggatcaacaatgcccttgtctatgcaatagttaataagctacattttttttttgtttgtttgtttttgttgagacagtcttgctctgtcacctaggctggagtgcagtggtgtgatctcagctcactataacctctgccacccgggttcaagtgattgtcttgcctcagcctccttagtaactgggattacaggcgcccaccaccacgcccggctattttcttttttaaattttttatttttagtagagacggggttggtctcaactaaatgttggccaggctggtctcaaactcctggcctcaagtgatccaccctcctaggcctcccaaagtgctgggattacaggagtgagccactgcacctggtctttttatttgtatttgaaagcagcctgagtggatattttaacaccagaatttccaaaagtatgtagcacaggttgttacaacaaaatgacagcacttaggaataactgctaatcttaagtatgttttttataagtaaaataacccattatttggtataaagatttcacactgataacatttttgagttatcaggcaaaaatagagagtattgagaaaagagaccctctcaattttgtttaatttgaaaatattaacatttaaaaatcacactggggtttttcaggtggtgggactttttcttcatttaagtggagactacccagtctttatgttaatggttgataaatcatcctttcagtatcattatcattaggccaatgtgtgcaggcctcccactgcagagattgactacttttttctggcatctaattctatgcgtgggaatacattttccattaatgtgagctcactcaattttacctggaagcatccatattcctaatgaaattggaatttttccaaaagatgaggcctggtcttggatgactacattttcacttgaaacatttattttgggtaattataacactgaactcgacaagtaaatgttacacttggaaagaacttttttagcttttccaaccaaaggcagatgtattgcaataaaataactgtcttaaacggtcctctactatttagttcttagttatttgctgtttattctaaatatatgtgcatattgataaatcatagaaataacttccactagtgatcttacctttagccatttcatagttaggtcagaatatccatttccaagtaatacttgaccactatgtttctaccataggtaaatgataagcttctaaaattatattcacatatatccaaatctccaggagtcacaatctgttgctctataagttttttcaaaacattcttatttacattttttcttggttgtctaagtgacatctaggtggtagtagaaattattcactgatactttatctacaaaatggctcaatcttctaaactcatagttcctttaatattacctttatctcttaataatcagtatggagtctactctgctataaattctcatgtgacattccattttgcaattagtataactcttaaaggtactgaaaagtgcagtattacaataagttgtcaaaggcatctcattactatgaagtccatgaagtttaaaaattttaaatttatctcttattttcaaactagctaccatctttaaaaattcagcaaagtggtaactggaatattaatagctataattatttcttaggtccatgcttttcagaaataatgcttaaatgtttacttacttcttcataatatagcacaatataatcatttagaaattatgtaagtttgatattaacaaatatcattaacttacatttttatttatcttgcttgaaaaagttaattcaaaatattaatttatttattcatgaaaacaacaattgataatttatcctattctaaatatgaatgataaaatctgagtaagttgcagtcctggcttccatttcatgaatacacaggaaacaaaagctgaaatgaaaacttttcccctaaatatttaaatcacatgtttgatttcatttttaaatggtctgggtataagcaaaaatttgtacattattttatttctctaaatttgacctctttccataaattttctttgccccacttccaaatgcggcgagaattcatgcttctcattgaattcacagatatctttagaatgttttattgcttagtgttaaatatgttgagtaaatactggcttatgttcctaggttacttttctcccttcactgtttagttaaataatcaattctttcaagtaacaacttttaaaaaaactggaatctagaaattcatcaggagtggagatcatcaaaaacgtaattactttatattgttaacattttagtatatacaggtaaattcaaatacataaagagtgtggaaaaattaaacctaatatattcttaattgatgtgatgtgagtgtaacaaatatacaaatcacattcccacaataggaaacaaatttcctgtttgaatttctctgtaaaggaccgacttctgaaatctttatgtaagttacagtcaagacagttgatgaggctatagttcttgaaaaaggggcatgggagggaattacagacattctacaaatttaaaaaaccataaatgtacatattttaagaaattaacagttgctgtaataacataaaagtagatatatgtatgttttaatatatacagcacacacacacttttaaatacttcaacatctcaatgttttgatgatcataaatctgaaaggatctgatttttctataaaatgtaacttgggtggtaaagaggttaatggtaagttgtcttgaatcagattgaaatcccatcgtaccaagagataatatcgttttacttaacctctatgtgtttataaaaagcgaataatattaaaacttatttcagaggattgtgataatttaacgggataattccattaagacaaatagaaaagtggctgtcacatgggaaatatttccaatagatgtccactgttaaaacaggaatcacaatattttagtgtatgtcatgaattagcacaattgatagtgaattagtataaaagttctaaggaaatatttagataaaatataaggactttgaggagtgaccgaaggatattacaattgaaactagaaattttgggaaagttcaaacgacatacaaggaaaagaagatacgtttacatatttaatacttacacgtttagccacatgatgtcgctgtccaccacaaggtctttctccacaaaagaaataacagcgtgcattacgtattcagatactgctttgcttcatcctctctaaaatttaacaccgaggagtttaagaaatgaagataaggaactcgaattatttttaaactttggatcaatgtaaaggcaatctaatatttggaaaatacttgcaatgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaatagttaagtatgaattatgtgattcataattagacttttccagttttgtggttttgtggttaaaacggtaagatttttgttgctaatttttgaaccaaatcagcagtaagttatgatatccacacttgtaattttgttttgttattaggtgcagtagtagaattattttattgctaaatgcctgggtataagacaaatattttttcttagatgaattgcattatttagagaatctgacttcgacttgttttatacttatccctatacaatgcttcttcaatatcttttgccacttttcatttggacttcctactacctgttagtacaaatgttacttgctcattttatgagttcacctaatgcttataactccctattgattatgcttttccaccttcagtttcaaaaattagatcattacacctgttgtcttttatggaacctcttttattctcttattcacttgtttggagtctcaatccttattttttacttgaatatgattcattttaggccttgtgctctaatttggcaataccgtttattgtttcttgatttcccagttgggaaaaaaatcgagaataacaattgcatttagaattgcatctttgttcatctttagtttatcactactttatttaatactactttaataatactactgtattatatgttaaaatttattactaataactaaaatatcaatatgaagtgaaaatttaatagttgtatagtatatttatatattcattttaaaagaatgttttaaatcttgttaaaaataattttcaatctgaacaatatcttgaaaataattatggtatctaattttaaaactatccctactagcaaaactttttattcattagtgtcttttgcataccatactaaggatgctaatatgaaataagtttgataagccaatgttataatgttattactggttaacttctctgaatagcatcctgcctattaatgtgtgccatgcaataagtagaaaactccaaataaccagaaccaaatgaaattgaaggtagacttttttctaatcactacccctacatatttggttatctcctctagcaattagttggactcccatttaagtttccctaccactggagagaaatagtaaccaactgaaacctggttaatactcattgacagtgtgggaggtctaacacgtaaaatagatatttttcttgactcctctccttcccctcacttccattttctttatttccttttttggcactatcctttgttgctcccttgtccatgaagtagtagccatagtgtgtccatctcaggtcagtattttaaaaatttagttctgttatcagcttcttgaatataatagagtcagccaaagtacttgtcttcccagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaagaaaatgtattgtggtttatttattgggaagtcttcattccccattaatacccaggatgattcaaagatcatgattaccaagaattagaataaaaattaagctaaaacccaagttttcaacattgaacttgaaatacatcttaattggggaaatgtctagagactttttttgtatctttagaaaatcatagaggctattgaaacaccacattttcccaactagatatgcgatcaccttaaattaatgcattttattaggcaatggaaggaagcaaacattttctgcagggtaaatatttaggaaatattaggtaagtccctctgagctattaaacaattaagatacaactattccctttaaaatatatattccaaaaaaggacacacatactcaaatgcttataagagataaattaatgtaataaatggcccacgcgattccaccctggtgctgcagtttgtaaaagaagaaaaaatacctgttcaattggtttgatcatgacattcttcatgggtcagggaagttttaagtggttataaaatggggtaaattggctttagaagagtttagaaatgatgtggattacttatagacaggacaaaatgaacatgcttgtttattaaaaaaagctattggaagcaggaaatattcagtttggctaaaatatataagcactataggagaaaatagaagcttaggcacattacatactggagaacaagcaagtacttataaactgtaagagtcaaaatgagaataccagcgtttctcatgggagcaaatgagttccaatgaataaaattatttggaatgcttttccatgcaagctatttgctataacttcctgcttccttgcactttcagccctgacatgactcaaggaagacatctaattaaatgctgatggtctttgatccttttataaaacatctgcaaatttccctgtcaatagcttgttcttggcaccagaagttccctagagaccagtcccctcaagtcaacaacaccagaaatactagggtgaagagggtgttatcattaataaaaaaaaaccctggaattcttgggaacacaggaatctgtaatgaatttttctaatcaacagtttacagttacatgtttacaaagtgtatagttaggtctctgtaatacttaaaacctgtgttgaaaaaattatttctactgaagtaaaagttgcccctatggcgaaactaaggaccacactcaatcaatcagtggtacaatgtgtaccacagtagtacaaaatgtattcctattctccgaaacgactgaaataataaataaaaccaagtagtttacagtagagtgtgtgggggtttccacaattgctacttacggtttggagccacatgatgtcgctctttaccacaaaatacatgagagaaggaggaagaagggaaaattccttctattcttactggaaggaaccatatacactctttggagtctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataacatccttttgtttaattttcgtattgtttttctctatcaacttcttcgtaaatttatttctaagagtcaaatttccctgggttaaaattttacctctttttacatatccattttaactaaagtcttttggaattataggacatcagagcaatatatattgccttccttcattttatgctgcattattcaatgcatattaacagaactgtaatttctagtaaattttcactatattcaccctctttgtttttggtaataatcaacattttagaaaacattttactattatttaacctattacatataaacaaatgtgcacaggctgaaataataaagctccataaattgtatgaaagtgaaaagctccgttgcctccatcgctgaagcccctcgcatgcacctgccaaatcacttcccttatttttcctccagtgtaaccgcacatttgccttttataactgtttgttcggggcctgttttgggaacgttatctaattggacttgcacaacatgtattgtctgtgcatttgtgtgttatttgtatttatcactcattgtttatgaaattatccatgttgttatatgtagttgtagtttatttatttctgtttctagtactatttcataaatatactataccttatttattctactgttcaggaatttgcattgtgcctcaatgtctatttcaaataatgccatcataaatatattgtacatttctttgatgcccatgtacacagatttctctcaggtttttgcctaagagttgtgtttgtgggtcacagaatatgtgtgtatctttgtcttttgtagctaacaccaaccaattttccaagatgtttttacctgtttacattcctagtagtgcataaggctttctgctgggccacatcatctctacatttgtcaggttattttcatgttagccattttactgggtgacttttgtaatctcattttgaaattattttatatttaaatgaagttgagtacctttctattttattttggcaatttttataccttattttgtgcaatagctgctcaaatctcctatttctctagtctgttgtttttcttttcttttttctcttctttttgcttccatagaactttatttatttccttatcttgtttttcttattacttaaacaaatcttgtattctgaacataactcctttttttagtagttttcaacctcatggctagtttttaattcttttttgtcttttggtgaatagaaagtcataattttgattaaactcaatttatcaatttttgcttctgatcctatttcacaaagataattttctgtggtatcttttatttcattgtttacattacatctacaatccatttggaatatacatatttttatcattgttgtgaggtaggggtcaagatttatttttattccttcttattatttttattatactttaagttctaggatacatgtgcacaacgtgcaggtttgttacataggtatacatgtgtgccatgttcgtttgctgcacccatcaactcatcatttacattaggtatttctcctaatgctatccctcccccagtcccccacacctcaacaggccccagtgtgtgatgttccccaccctgtgtccaagtgctctcgttgttcaattcccacctatgagtgagaacatgcagtgtttggttttctgtgcttgtgatagtttgctcagaatgacggtttccagcttcatccatgtctctacaaaggacatgaactcacccttttttacggctgcatagtcttccatggtgtatatgtgtcacattttcttaatccggtctatcattgatggacatttgggttggttccaagtctttgctattgtgaatagtgtcgcaataaacatacatgtgcatgtgtctttatagtagcatgatttataatcctttagatatatacccagtaatgggtcaaatggtatttctagttccagatccttgaggaatcgccacactgtcttccacaatggttgaactagtttacactcccaccaacggtgtaaaagcgttactatttctccacatcctctccagcatgtgttgtttcctgactttttaatgattgccattctaactggtgtgagatggtatctcattgtggttttgatttgcatttctctgatgaccagtgatgatgggcattttttcatgtgtctgttggctgcataaatgtcttcttttgagaagtgtctgttcatatcctttgcccactttttgatagggttttttgtttttttcttgtaaatgtgtttaggttctttgtagattctggatattagccctttgtcagatgggtagattgcaaaaattttctcccattctgtaggttgcctgttcactctgattgtagtttcttttgaagatttattttttactaccatttttttgttggacttttaaaatgagtttggaagtgttccctctccttcaattttttttttttggaagagtttgaaaacaattatcattgattcttctttaaaagtttggtagaattctccaggaaagatatctggttttgggcttttgttgttgttgttgttaggaggtttggattactgattcaatctccttactagttacagctttgtttagattttttatgattatgtcttggtagtttgtatgtttctaggaattaatcaatttcttctaggttattgaattttttggtatatgattttaaaagcctcttataattgtggcatcaggtgtaatgccacctcttttgtttctgacttccagtctttttgtttttttcttagtctagctaaggggcttgtcagttttgttgttttttcaaaaaatcaactaagtttaaaaacttaatttaaactttttttcatttatttttgctctaatctttattatagtatttcctccctttgctttgggcttcctcatttgtcctttttttctagttccttgagttgttaagttttttatttgagatctttcttctttcttcatttttagtgtaggcatttacaactcccttctttgtttttgttttcatgtttaagagacaagatctcactatgatgtacagaggcacgatcatagctccctgcaagtgatccttgtgccttggattcccaaagcactgggattacaggcgtgagccactgagcttgcccagcttaatattccttcttagtactgcttttgttgtatcctgtaagtttttattgtgttgtgttttcatttttgtttatcttaacatattttctaattcatcttttgatttcccctttcattcaaatgaaattttgaacagaatttcgttcaaaattctgttgtttaatttctacatatttgcagattttccagttttaattccagtattgatttctagttttattccactgtggtcagaaaagatatttagtaggatttcaaccttcttgaatttgttaagacttgttttgtgacctgacgtgtgatttatcctggaaaatgctctgagtgtgcttgagaagactgtatatttgctgctgttgggtggaattttctgtatatgtctgttagttccatttcagctatagtgttgttcaagtcctctgcttccttgctgattttctgtctgaatgttctattccttattgaaagtaggataccaaaatctcctactacagtcattggagatacattctgagaattgtatcattctgagatttcatcactgtgcaaacatgagagtgtacttacatatttacacaaacctagatagtatagcctactacagacctaggttacatgatctattgcttctaggctacaaacctgtacatatgttaactgtactgaatactatagggaattgtaacacaatggtaagtatttgtatacctaaatatatctaaacatctaaaaggtacagtaaaaacattgtacagatttttaaaatggtacacctgaatagggtacttaccctatgaatggagactgcggggctggaaatttatctgcatgagtcaatgagtgaatggtgagtgaatgtgaaggcccaggacattactgtgcactaatgtagactttaaagcactatacatttaggctacactcaatttatcaaaaaattttctttttacaggctggtcatggtggctcatgcctgtaatcccagcactttgggaggctgaggaaggaggatcacttaagcccaggagttcaagaccagcctgggcaatatagtgagaccctgtctctagaaaataatttttaaaaattagctaggtgtggtgacacacacttgtagttccagctactcaggaggctgaagtgggaggatccttgacttgaggaggtcaaggctacagtgagctatggtcgtgccactgcactccagcctgagcaacagagtgagactctgtctcaattttttttctttcttcagtaataaattaaccttagcttactgtaacttttcaactttgtaaacttaaattttttaaccttttgactcttttgtaataacgcttagcttaaaacacaaacacattgtacagctgtacaaaaatattttctctttatatccttattttacaagtttttttgacttttaatttttttatttttttcacttttacttagtgtttttttttgttgttgttgttaaaaatgaagatataaacacccatactagcctaggactgtattgggtcaggatcatcaatatcattgtcttccacctccatatcttgtcccactggaaggtcttctggggcagttacacatgcgatgctatcatctcctatgataacaatatcttctagtggaatacttcccaaaagactttcctgaggctgttttgtggtgaccttttttcttttttttttttgagttaatgtattttttataagtagaaagagtacactgtaaaataccactaaaaagtatagtaaatacataaagcagtaacatttactatctgtatcaagtattatgtactgtaaattactgtacataattgtatgtgctatcttgtacttttatataactggtagtgcaataggtttgtttacaccaacatcaccacaaacatgtgagtaatgtgctacaacattatgactgctacatcatcactaggtgataggaatttttcagctccattataatcttatgggactactcttgtacatgtggtctgttattggttgaaacgttgttatacaacacttgactttattgtattgctatctatttctccatttctgtgaatgtttgcctcatatatttaggtgttttaatgttgggtgcatatgtatttataattgctatgtccttctggtgaattgaccttttatcattatataatgtccttctttgtctcttatgacactttttgacttaaagactattttgtgtgatgtagctgtttccacatttgcactcttttggttacaatttgcatgaaatttttttaatatcctttaactttcaggctatccaggtctttaaatctaaagcaaatctcttgtagttagcatataattgggtctttaaaaaaaatcaattcaaccactttgtatcttttgattgggggagtttatcccatttttatttaaagtaattattgatagggcataacttactgttgcctctttgttaattgttgtttgcagcttgtagactttttgctcctctttcctcctcttactgtcttcctttgtgttttattgagaattgtaatgctatgtttttgttcctttcctgttttcttttgtatatcttccataggtattttctttgtggttaccatggggcttacattttaaaactcttataaaaatgtattttaaactgatagcatctttactacaatcacaaaacaaaactcattatgtttacttctcccctacccaaattttatgttattgatgtcataaatacatctttttatattgtgtatacattattttatagttagtttttctgtacttttgtcttttaatcagattttaaaatatcagattttaaagtgacttttgtaccaccattacagtattatagtattctgtttttatctatatatttatctttactagtgagctttatactttaataaaatacctatgtatttctgtttagcatcccctaattttaactcaaaaggccccctcttaacatttcttgtaaggcaagtctaattgtgatcaccttcagcttttgtttaactgggaaggtctttatctctttttcatttttgaagacaaactttggtggatttggtattcttggctggcagttctttttcttttcagcactttcagtataacatctcacccctttctggatggcaaggtttctactgagaaatctactggtagagttaggggtgttcttttgtacgtgatgaggcatttttcttttgctgctttctaaattcttaacatttcttggatcttgatgtccatttccttcctcatatttgggaagttttcagatgtaattttaaaaaataagctgtctgtccttttctcttatggcttcttcttttgaaactgtcataatgagtagagcagcctgctcgaggatgtcctatcaatttcttaggctttctttactctctttcatttcttgctctttttgctactctgtctggataatttcaaatgatgtgtccttgagttcactgactcattcttctacttgattaagtctgctgttgaacatgtctgtaaaattttcagttcaattattgtattcttcagttccaaaatttctttttagttcttttgaatattttctatctgctgaaattctgattctgcttatgcattattttcctgagctcactgaacatctttatgacaattattttgaatactttgtcaagtaattcacatagctctatttctttaggtttggtttctggaggtgtgtttgtgtgtgtgtgtgtgtgtgtgtgtgggcacgcactatttgattgggccatgtttcctgttttctcatattccttattactttgtgttgatatctatacatttcaaaaaaacaaaaaacaacaacacaccagctacctcttccagtctttatggactggatttgtacatggaaagatctttactaatcaggctggctagagattctagggacctctcaaaccttttctgtggatgcatcttctatggacttgtgtgtataattcctaattagagggatctgccagcttttttttttaagatgctctaatctttttccctctgtggtgtctgtgtgctgtactgtgggccctctggagcagcagtattcactcagctcttttaggttctgagaagccctcagttatagattctgctgaatcctatcagtgcctggagtcaagtgagacagaaacttggactgcccactaaaattcaggaactttggatgcattttactctctctttccctcatgagagagagagtgctgagctgagtttctctctgtgtgctgtatcacaggtcctgaggagcatcagcccgccacccagctctttattattctgagctgccctcaggattttagaatatgccaggttccatcagtgctctgagatatgcaagacagctcccctgaaaagtcagaacactgaatgcatgctttactttctctttcccttctcagggagaagacaggagctgggaatttccccctgtttgaatggaactgtgctgctggatgggactatagggaaagtgccccagaaaagtgcccagctagttttacacttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattccaggcaacgctaagaccttgaatcattataccatttacttgtaccctactttttgttactgatatgcctttcaattatttatatgttctagacacacagtacattattatcattgttttgttaacacctatatatgtttctttctgggatcattttccttctgaagaaattaacatttcctttagtgtggcctgctggtaaagaaacctttacgtttttatatatctggaaatgtcttaattttactatcacttttgagaaacagttttgggtattgaatgaaagttatttttgccagcacttttaagatgacattccatggtcttcttttgagatgatggctgtcaagtttattgttcaattagtgtgtctttttttctgtctagctactttgtatacttactctgtttttcacttttaacagctttactatcatgtgcccagtgttaatttgctttgtttttaatctcgcttgcagttttcaaagcttcttatatctgtgggttgataatattttatcagtttaagagaagatttagcagtatgccttcaaatacggcttctacttcatattttctcttatattcttctgtgactataagtacatgtatgttaaatcttttcaccatattccttgtcttttatgtgccatttctgtttttaaatcactttttctctttgtttcataatccatgttttattctgacccatcttttactttaggaattttatcttgttattctaggccactgtcaaagtcattgattgaattcttaacttgaatcgtggcatttttccattttagaattttattttcctttttaaaaatatatttctaacttgggtactggctaatgtcaaaagaaactttcctcccacaaagttttcactcacttgatcttggattttaaaatcagatataacctgagagattatcatttttctccatttaataatgaatcaggccaggcatggtggctcatgcctataatcccaacacctgtgtgggccatgacaggaggattgcttgagcccaggagttcaagatgagcctgagcaatatagggagactccatctttacaaaaaatgaaaaaaattagctagatgtggtggtgcacacctgtggtcccagctacttgggaggctgaagttggaggatggcttgagcctgaggctgcaatgaactttgactgtaccactgcactccagcctcggtcagagtgagactctttgtcacccagttgtatagaatcaactataggtagaggcataaaaaagatgcctgagattgcatctcttgaatttagcttcattgtccctttctattaagtgagattatttgacatgaacattgatattcactatctcagggatatgttagaactattctcatattttctatccacagaggatatataatatggatattttagcacattcccttatagggcagttataccttcctctgtgactcattatacaggcagcgctaagatgtgtattatatgctcatggtatcctttcttactatccttataatagaataaattaatttttatacagaattaatttttgaagaatcaaatgacatatgtgcataaattatttatacatttttatacaattgcttcaacatttcctcttctctgcaatctggtatatctatataatttctatagataagagaagaaaaatatagcttattaaaattttattctgggttttgtaaggaataaaggacatttgtacccttatgaagattaaattttcttgtgttagtatatttctaaaggcttttagtgaattaaatggagacactttaatatactacacagttttaaatctaaatttttttctcaaggaagaacttctgtttacacaatgatgcttaaacatgactgaaatatctaaaggagaggttaactggatcagtcaagaaaataatctgtaacatttgattgaagaaaatagcttagaagaagattttttaaaatgttcttttcctgtggagtctcccatgaaattcagattggataatctatagttactgagaaaggaatattcaaaataagagttgatcactgtagcacaaatgcaagtgataatttaaaaagtaaatataatttaacagatatgaaagtgaatcaaaagtcaagagtcttgtttcctcctgaaatatctatataagtacatgagatattttttccagactgagaggagcatgtgaactgatattgttgatgactttttctccattgagtatatcttttaaaatactcagtatttatcataatactctgcagattacaatgtacacattgttaatactacattgttaatttgccttttaaatacttaatatttacttttttcaaaggttatctttgtgtattttgtataaaattctactataatttattccatagctttgtagttttacattatttactgttatataatagaaagtggctaacatcagctaatgctgttttctaaatatttattatcattttcttatgtttttaaccattgtgtattaaaatatttcaaaattatcagtatgaaaactattaggcaaatagtctgggaaattgatttgtgtttcaacgatccaaatattagtgaaaagtcatgataatagagatagtaaaaatcttataagggaactggtaaatatatctttaaagattgtatcagaaacaattctatgacaatatcttgtttctttacaagtttgaattccagaaatcaagtgaatttcctctgactttgcattttctggtaatttcttttttcttatcaagctatattttaaatgtaaaagtatccaacaatagaattgctaatctcttggtccctcttgtcttcacaggtaagggatattttgtaatatttaaggaattttatggagtatatatacaagcagaatgttagctatttcttcaatagaaaacttggtgatattttcttttgcccatatttattaagtgaagtttactaaattttctaggtcgtgttcaaatcataccatccagtaaacagttgggagattaaaaagtaattaaactaatataaagatagcctggttaataaaatgatattcttttcaacatgattatatttactggaacctaaacattttgtgaaatagtatgtcatatagacaatattaggattttgacttgttatgtaagtacaaaggtatgtattttacaatttttaataattgctttatcagtaatagcaacttgaagaaatgctatctagatgcttctaatttgaaaatagtgcaaagacgatttaccaaagtcgttctattatgcttttgatttctagaaagctgaaatatccccattacagtttttgagtcaatacaaaaagtagataggtgttatagataaagaaataggttttcatcgatttgaaaattagaactccgagaagaaactcaggtaagaatgccattaaaatagttttagttgtttttgaaaataacatcaacaaaatgtcactattaaacagtgaaattggaataaaaatttgttttatgagtaacacggagatagcatacaaacattccattgactaatacagaaaaaactcaaaagttttaattagatatgtttaaatagagatgagaaaagtcaaaactttaactcttaaaagttatttttatcagtttggaaatatataaactcctccctatataaaatacaccagcacaaatttctctagtaaggattggggtttcatgactttagatgtatttttctgtaatattttaatgacgcacttatattgacgcattttaagatagagtttaatgatatattttgactagagataagtgatttaaagaataagaatcatgtcattgaaagtgagaatacttgagaaatattgacgaatataagctaaataaagcaaaacaaaataaaacacttaccctttcatccacatgatgtcgctggacaccggaaggtttttctcccttcccagcctcaaaggaatacagtgagtagattttccttagacagaaaggaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattaaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttgtaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacacagtaatttaaactattcactattttgtatgtgtgtgtgtgtgtgtgacagggtcttgctctgtcacccatgctggagtacagtggtgcaataatggctcactgcaccctcgaatgcctgggctcaagtgattctctcacctcagcctctggagttactacacacgagcaccaccatgccccccaccttttttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctacataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtatacagaaaattccaaatgtacctagaaatgaggaatagtccactttgggtaaagcacatggttcccataagagagagtgtgatataaagcaagaaaagtaatatgagaaaaaccttttgtataactttgagtactagacgagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcgtaatcagcaaaaggaagtcattccttttcgcactggaaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaaatcatctgttcaattttgcctttttatctttagtctagaacttgaattttaagcatttcttttacatctatttatcttctttttatcatatttgtgtagcactgacttctttttaacttactttgttgagatgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttactttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatatatatatagtgtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaatttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttgtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagatattcagttttgtggaaaaatctataaatatctttgaccttcaaagatgtaactgtaatctgtttttattgctttgcttttatgcttacatgcatgtatatttaaaaccttcctagcatattattaaagttttaaatatcctatttatattgggaaatacctgaagttgataggggatcctccttagccacctaagctgtattcatcaattattatgatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcctgagatatcgagaaatactattttctttacaaattgtttgctactatttagagtcaactacagagatttttttgggtaaataatgtgatgacaaatttaaatcatttcacagaaaatacccttatttgcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcttttagctattaagaatttctgggattgaaatgtgtcagaagttagttattaagtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttctttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggagacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccgtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctaaataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacacgtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaaatttttggaataactgaagatcttttaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattacttaacgttttatagtttatttaagttatcttatacttgtagagccattcttggttactctttcctggtgttgtaaaggtgtcatatttcagttgcctttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaacattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggactagaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcagctgagaagatgacattgccattaaccaacctgcagaacaaggttggagaaacagtttgtgtgtatttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtgtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagaacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttactttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatatatatatacatatatagagagagacctggtaggctttttgttattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaaaaaaaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttcatttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacattgcaccatatttgcaatcttttatccctcgccaccccccactcttgcccccaagtccccaacgtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgtttgggaaatactttatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctgcatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacgtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacaggcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacgtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattgcatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacatacgatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagtttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagaaaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggaaaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaacatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaatttctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacaatcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagagtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaaatcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagacctctaggccagcagaacataatgtcacagggacagtaagcaaaaattttactagtgggtcactaggggtgatggtaagtggtgccacttccacttccaccccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttgggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccggagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacctatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactgttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttataatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttcagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcattgggtcatgttttttcatccattcagccactttatttctttttattggagagtttagtccatttacattcaataatttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactacggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactcttttctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggaggggtgatggtggtgatcccagagtgtctctccaaccctcttcaatgcctcttttagtgatacgttgttaaatctaggtactacgattgctcacctgatgtttggtttttgtaatgacgcttttccgtgtgcagatagttgttacaatttggtgttcatgtggcgggggaggggggggatggtgtaggcttctgttccactatcttgctccacctcaatagtctgatgtgcagaagctctttagtttaattaggccccatttgccaatttttgtttttgctgcaagagcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatattggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaaaatgtgacatccatgaaccaaaaagtggccccctccccagacactaaatctgctggtgcctgaatcatgaactttcaagcctctagaacagtgaaaaataaatctctcttgtttattaactacacagcatatggcattttgttataatatcctgaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacactttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatggaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtataatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcattttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaacttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaaaaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgtagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcccagaagtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggaatttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataataaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatagaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagggtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgattcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagaaaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactgcttaatggtgtcttttgattagcaattaatgagctccaatttatcaatattatcttttttttttttttttgagacagattctcattctgttgcccaggctggagtaaagtggtacaatcttggctcactgcaatctctgcctcccgggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtctgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcacgatagatttttatacaccttccagtgagtgaatactactgctagtaaaccactttaaatcaagttcaagacttgaagctccttggctacttagactacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttcttcctttctttcttcctttctttctttctttctttctttctttctttctttctttctctttctttctttctttccttccttcctttctctttctttctttctttctttttcttctttctctttttttttttttttcagatggagtcttgctctgttgcctaggctggagtgtagtgacaggattttggctcactgcaacctccgcctcccgggttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattattaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaagaaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcattttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaaaaaggtttcttgttaaagataaaggaggcctgagtaagtttatatctcatgggaaaatggtaccagagaagaaaaggttgaagattagaagagttgaaaattaaagggccaaggctggttttttgttggtttgttttgttttgttttgtttttaaagagggttttactctgtcgctcaggctggagtgcagtgatgtgatcactgctcactgcagccttgacaccccgggctcaagcgatcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacaccttagtaagtctgagcatttacatggaaaaaatgctgggtttattcctcctgttattgtattttacaagtctgtcgagggtccacagtgatctttgccccataattgtaaaatgagatattagaatcatccttatttatcttaaccacctactccactgtacagttcctataattccacaaacttctctttatattggtttatgccttctttagatgattgtgaataagagtattatcttaacctctctggtgggtctacttctgtaacggttgtgggtcatgaattattttttactcagacataattatctttggtcttatataaagaaaaccctacagactccaccaaaacactcttggaactaataaacaaaataaagttgaaagataaaaaatcaacttacaaaaatcaatagcatttctatacactattgaactatctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaagtttttacagaaatataaaaaacttccctaaaatttgcatggaaccacaaaacaccccaaatacccaaagcaatattgagcaaagtaaataaataaataaaacaaaacatacaaacaaaaaaatgaagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaaactaaaaagctcctgcgcagcaaagaaaacaagagtgaagggacaatccacagaatgggagaaaatatttgcaaaccacagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttaggtgttcatagtggatgaatagataaagaaaatgtgaaatatatatatatatatatatacaatggaatactcatcagccattagaaagaatgaaatcctgtcattcgtgacaatatggatgaatctggaggtcattatgtttagttaaataagccaggcacagaaagacaaatactgcatgatctcattcatgtggaatgtaaaaaagctgatcttatagaagcagagagtataacagtgattaccagagatgggtagggcagtagtaaggaggagagattgaggagaggttggtcaatgggtacgaagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatactttttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcagctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaatttaggaagtaccctttctggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgaggggtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgctgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgttgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttacttagcagtttttgtaatgcatatatgctgcagtgatttatcttagttttcctttatctgaagatctatttatcttccatttgaatgatatagaattctgggggattgacagattttattttcttccacttaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttcttatattttcctttttttctgataagatttcctttattttcattccttaccaataagttttcctttatcttattgaatatagttatagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtgttagtccattattgcactgttataaagaaacacccaagactcggtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggacggggggaagtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccgcgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggatgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattctggggtcttgagggtggtggccctcttctcacagccatttcactccagcctgggcaacaagagtgaaactccatctcaaaaaaaaaaaaaaaagaaagaaagaaatttcctctgccaggtaccctaaactcatcattctcaaatttaatgttccgcagattcctacagcacaggcataatacagccaggctctttgctaaagcataaggaaagtgacatttgctccagtcctcagtaagttcctcatctccatctgagacctcctcagactggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaagcatgatgctggccatctgcttgtcttctggggaggcctcaggaaacttacaatcatggtggaaggcaaaggggaatcaagctcatcttacatggcatgagcaggagcaggagcaagagagagagaagggggaagtgatacacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttggtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacgggaaactcacttcatgctgattcttttctccaagttttagtgccctcctctcccaaaactgcctccttttgtttattccccagagtccttagatatttgctttatgtattttggccaggagctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgctctccctcccattgctcccccaacaggccccagtgtgtgttgttccccttcatattttcatgtgtactcatcattcagctcccacacatagtgggacgatgtggtatttggttttctgttcctgcattattatgctgaggataatggcttccagctccatccatgtccctgcaaaggacaagatcttgttcctttttatggatgcatagtattccatggtgtatatgtaccacattttctttatccagtctatcattgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctcccacaatgagtgaactaatttacaaccccaccaacagggtaaaggtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattacgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtgtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgagagggacccagtgggaggtaattgaatcatgggggcaattatcccatacagttctcatgatagtgagtgagttctcattaggtctgatggttttataagggctttttcctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacaaattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtgttttattctctttgtagcaattgtgaatgggagttcattcataatatggctgtctacttgcttgttgtttgtgcataggaatgctagcaatttttgcacattgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatccttgtcttgtgctggttttcaaggggaatgcttccaggttttgcccattcagtgtggtattggctgtgggtttatcatatatatggctcttattattttgagatatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgcttatcagggatatcagctggaagttttcctttttgttgcatctctgccaggttttggtatcaggatgatgctggccttaaaggagttagggaggagtacctccttttccattgtttggaatagcttcagaagaattggtaccagctcctctttgtacctctgatagaattcagctgtaaatctgtctggtcctgggctttgtttgcttggtgggctatttattattgcttcaatttgtaatttaatatttttaaatcttgggttaaatggttgaatgaatgtgtgaaaagttagatatcaatgaatgaatattcttaaatgtataaactttaatcttgctggatataggataaaatttacattaaaacactgtaattaatcagtcaatttaagtaaaataaattcaaggaagtggtctgaatttctcagtgagcatttagatatttatgggagtcatataaaataaattataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaacattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtattttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaagtccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatacagaaaagtctgcctgggtgtggtggctcatacttgtaataatattatattattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaccccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaatttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcaataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatcttattttagtccatgattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgatggaatttatccgaagctccaggaagcttctttttaccatggctctgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactttgtttaatgtctccacaaattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctcgctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttgatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacaataatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagagagctcttgaaggtccaaggaaaggaatgcataatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgaggacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagagtgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcaactcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctatggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggaggcagattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtactttggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcctcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattctgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctgctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaaacagatataatccctttcatagagtttactgtctgacaaagaaagaattaggatacatgcaacagtatgtaataaagtgcaaaatctagtactgtgtagctacttaaaacatattatatgctttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcagcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctatgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctcaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccataggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctattcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccgttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcgttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttaccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgattctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtgaagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctggggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggccattgcctaatctggagaaacatattcagttcaagcactggctagagactagaggcccccaggaaagggccataagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgcttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattgacccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttgagcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacaatagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctagcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtctaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctggaaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcacagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtctgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcaagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaatgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctctatatatatatatatatatatatatatttttttttttttttttttttttgagacagagttttgctcttgttgcccaagctggagtgcaatggtaagatctcggctcactgcaacctccttctccagggttcaagtgattctcatgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttatgaactttttttacggatgaaaactgaggcccagagatatgaaataatttgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtataattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctttccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggacagattgcctgagctcaggagttcgagaccagcctgggcaacatgatggaacaccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttggtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcagctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 2131 - DNA, 226055 bp, Homo sapiens; identical to SEQ ID NO: 2130
